United States Patent 11,446,398 (REGULATED BIOCIRCUIT SYSTEMS) - sequence listing, part 87

SEQ ID NO: 193266 - DNA, 2413 bp, Homo sapiens
  Payload ID: 18150
  Gene Name: transmembrane channel-like 4
  ENST ID: ENST00000621826
  CDS Start-End: 134-2272
ctgagaaaccacaggaagtgtaccttactccctccgggccacctgctggccaggtacacacctgcccctggcccctcccttacctggggcagtgtctgcctggtggccactagagacagcccagcctggggccatggaagaaaacccgaccttggaatcagaagcctggggctcctctagggagtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcatacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgcca

SEQ ID NO: 193267 - DNA, 2412 bp, Homo sapiens; identical to SEQ ID NO: 193252
  Payload ID: 18150
  Gene Name: transmembrane channel-like 4
  Uniprot ID: Q7Z404
  ENST ID: ENST00000616323
  CDS Start-End: 133-2271

SEQ ID NO: 193268 - DNA, 3687 bp, Homo sapiens
  Payload ID: 18151
  Gene Name: transmembrane channel-like 5
  Uniprot ID: Q6UXY8
  ENST ID: ENST00000219821
  CDS Start-End: 258-2540
acagaattctctgcaggaaaacactccttctcctgagaaaactcctcaggggttagatgcagggagttatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacaggttgagaatgtttcctctggggtccaaagccacccatcctcaaatcagatttttcaagaaaaggtgctgctagactcaagcatcaacatggttttgtcaatatctgacattgatgtgatagactctcagacagtcagcaaaaggaatgaccaaaagggtaaccaggtgctgcggttttcaacatctttgaatgagtcgatgtctcagacccttcatagcctagaatgcatgggcatagacactcctggttcttcacatgaaactgttcaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 193269 - DNA, 4755 bp, Homo sapiens
  Payload ID: 18151
  Gene Name: transmembrane channel-like 5
  Uniprot ID: Q6UXY8
  ENST ID: ENST00000381414
  CDS Start-End: 762-3608
cagggtcgacccgagggccagcgcaagcagcggcaacaggagcgccaggaggtgaggcgggttcgccaggagtggggccagcgcccgggctgccagcctagcaggggcgtcttggcggagccccctcgccggctcccagagaggctgggaagaactgggaggggtgtccccaatgcggggcgcccaagcgtggcagcacgggctgggagcggggagccagcggggtgcggcgccggagtgcggggagaaccaccaggcgccggaattggggagcacgtggagggggcagcggctccagccccagaccgccgcgctctgtcactttgcattaagaaagcttccggggaatgcacacggcctggccgccgccttcgtgcagcccgccctgcaggtgcaggaagaaaagaataatcgcacccgtttctcaggtgcttacttcaccatgtccgatccggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 193270 - DNA, 4917 bp, Homo sapiens
  Payload ID: 18151
  Gene Name: transmembrane channel-like 5
  Uniprot ID: Q6UXY8
  ENST ID: ENST00000396229
  CDS Start-End: 750-3770
gagggccagcgcaagcagcggcaacaggagcgccaggaggtgaggcgggttcgccaggagtggggccagcgcccgggctgccagcctagcaggggcgtcttggcggagccccctcgccggctcccagagaggctgggaagaactgggaggggtgtccccaatgcggggcgcccaagcgtggcagcacgggctgggagcggggagccagcggggtgcggcgccggagtgcggggagaaccaccaggcgccggaattggggagcacgtggagggggcagcggctccagccccagaccgccgcgctctgtcactttgcattaagaaagcttccggggaatgcacacggcctggccgccgccttcgtgcagcccgccctgcaggtgcaggaagaaaagaataatcgcacccgtttctcaggtgcttacttcaccatgtccgatccggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 193271 - DNA, 3581 bp, Homo sapiens
  Payload ID: 18151
  Gene Name: transmembrane channel-like 5
  ENST ID: ENST00000541464
  CDS Start-End: 543-3407
aggtaaggctgggtcatggaaagaaagaatgaatgcagactacgggcggtgaatagaggtctcggatgccagcaggcgtcccaacccagcaggaactggctcaattctcagaagaaagcgatcggccccgaggcaggaaggccggctccggtgcagggagcgccgcctgcgggctgcttcgggccagggtcgacccgagggccagcgcaagcagcggcaacaggagcgccaggaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataaggttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgct

SEQ ID NO: 193272 - DNA, 4872 bp, Homo sapiens
  Payload ID: 18151
  Gene Name: transmembrane channel-like 5
  Uniprot ID: Q6UXY8
  ENST ID: ENST00000542583
  CDS Start-End: 705-3725
aacttgggacctgagttaggccttcatcgtcgcggactcagtagacagaggccataggtgcagctgtgatggtagaggtggaagactgatttgcattttcaccaggtgagacctggttactcattggttgatgaggaaagagatgatagccagggcggcataaaacggcaatgagctcagtaaacaacccccttcccgtgatcttcgtggcttcccgcccagacgtgtgaccaagatagcaaggagcagtctttaaggcgacacggcagagaggcagaaaaagatgggccttaccggttagttaagaaaaaaagaggacctgttgcctgtccctctagctttgaactacaaagtggaggggaagtttgtctggattttcctgtagaactgagggcaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 193273 - DNA, 2434 bp, Homo sapiens
  Payload ID: 18151
  Gene Name: transmembrane channel-like 5
  ENST ID: ENST00000564959
  CDS Start-End: 191-2260
tatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacagaagttaatcgcatcccttatacccatgacatccagagacagaattaaagccatcaggaaccagccaaggaccatggaagagaaaaggaaccttagcaggggaggcctcacaatcacgacagaggacgaaggaagagcaaaggcacatcttacgtggtggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgct

SEQ ID NO: 193274 - DNA, 2487 bp, Homo sapiens
  Payload ID: 18151
  Gene Name: transmembrane channel-like 5
  Uniprot ID: Q6UXY8
  ENST ID: ENST00000561503
  CDS Start-End: 292-2235
gagaaaactcctcaggggttagatgcagggagttatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaa

SEQ ID NO: 193275 - DNA, 839 bp, Homo sapiens
  Payload ID: 18151
  Gene Name: transmembrane channel-like 5
  ENST ID: ENST00000574033
  CDS Start-End: 1-98
acaggattggcatcttcttctgccccctgctgccctttatccaaatgattatgcttttcatcatgttctactccaaaaatattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaa

SEQ ID NO: 193276 - DNA, 463 bp, Homo sapiens
  Payload ID: 18151
  Gene Name: transmembrane channel-like 5
  ENST ID: ENST00000572147
  CDS Start-End: 1-128
tgcctttcgttgtgtcctgcattaatctggccgtgccatgcatctactccatgttcaggcttgtggagaggtacgagatgccacggcacgaagtctacgttctcctgatccgcaggggattgatgtagttctcaagtatgggatgtacagatgggcaggcagtgcacgcacaaaggctcctgggctgaggacgggactgaaatcatccagcgttccccttagtcaagctaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccag

SEQ ID NO: 193277 - DNA, 1681 bp, Homo sapiens
  Payload ID: 18152
  Gene Name: transmembrane channel-like 6
  Uniprot ID: Q7Z403
  ENST ID: ENST00000306591
  CDS Start-End: 94-1458
cctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgc

SEQ ID NO: 193278 - DNA, 2786 bp, Homo sapiens
  Payload ID: 18152
  Gene Name: transmembrane channel-like 6
  Uniprot ID: Q7Z403
  ENST ID: ENST00000322914
  CDS Start-End: 142-2559
aggaagcggaggaaggtgaagtaggaccgaattcctgtgccgaagaggcctgcagtgggagagcaggatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaat

SEQ ID NO: 193279 - DNA, 2833 bp, Homo sapiens
  Payload ID: 18152
  Gene Name: transmembrane channel-like 6
  Uniprot ID: Q7Z403
  ENST ID: ENST00000392467
  CDS Start-End: 189-2606
gcgggactgtctgggctgtgagtggcacctcctgtggttcccccaggaatgggtggtgtggacagctgccaggcgttgaagaccacccctggctctgtgcccctgtctcatcagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaat

SEQ ID NO: 193280 - DNA, 1155 bp, Homo sapiens
  Payload ID: 18152
  Gene Name: transmembrane channel-like 6
  Uniprot ID: Q7Z403
  ENST ID: ENST00000591436
  CDS Start-End: 1-1155
atggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctag

SEQ ID NO: 193281 - DNA, 5268 bp, Homo sapiens
  Payload ID: 18152
  Gene Name: transmembrane channel-like 6
  Uniprot ID: Q7Z403
  ENST ID: ENST00000590602
  CDS Start-End: 161-2578
gccgagacctcagttcccggcggctcttgcggggcacaggtgagccctggctgcgcgcgcggcccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgggcttgtcccttggggctctgtgtctgtgaccacacccggggcctgcttcccgctgccctggggccacctccaggcgcaggtctgggtcctgggaacctcagctggagtgggggcgccctctgctggccaagccccagatggcaggggctggaccgcgccagggcttgattcgcttgctgcctttgaccagcctgaactcgcgcccaggaggggcttacacctgcacaagtgagccgagcaggcacggattgtgaccagagcgatgcgtcaaccattgggtgatgctgtagcatctactggagcaggagacaaatttagagagggacttggaggggagacatatcagttgcaaatgagttgtggggacagttgcctcccaggcataggtaaccagcacctgtgcttggaggcgaacagggcttggtgaggtggggctggccccctgcttctggctgccagcagctggctggggggtggtgatcctgggtctgactgggctgagtttgaggagcccgtgggataccgaaaaccgtaggctgtggggggtgggcacagggattcggggaccagcccgtcatgaccccgtgctccaggtctgcagggaccagcccatgacagcccagggctccaggtctgcggggaccagcccatcacagcccagggctccaggcctgcggggaccagcccgtcagcctcagttctccaggcctgcggggaccagcccgtcatgaccccagtgctccaggtctgtggggaccagcccgtcagcctgtgctccaggcctgcaggaaccagcccgtcagcctcagtgctccaggcctgcggggaccagcccgtcagcctgtgctccaggcctgcggggaccagcccgtcatgaccccagtgctccaggtctgtggggaccagcccgtcagcctgtgctccaggcctgcgggaaccagcccgtcatgaccccagtgctccaggcctgcggggaccagcccgtcatgaccccagtgctccaggtctgtggggaccagcccgtcacggcgcagggttccaggcttgtggggaccagcctgtcacagcccagggctccaggcctgcaggagctgcgcttgggattgggggaatgaacccaggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgagacggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttg

SEQ ID NO: 193282 - DNA, 2389 bp, Homo sapiens
  Payload ID: 18152
  Gene Name: transmembrane channel-like 6
  Uniprot ID: Q7Z403
  ENST ID: ENST00000589553
  CDS Start-End: 700-1596
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcggcccctcctccccggcgcctcccagccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggtgtgtggccgcacatgaaaacatcatttggtgctggagctgatactggttgtttagctccgggtgtatccaaacctacttaggatgaggccggtgtgaccaagcccctggtgggggccctggggtgcatcttctgtcccctgtacccgcccctcagcctttgcaccccgccctccgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggtgagggggtcctgggcggactgggtggtgagtgttctccccttagtggccgggacgtgtggccgggaggttctcaggcctggacctttcccatcagggccctgtgtctccacccttcagaggaagactcaggaaatagaaccgaactcatttttagattggaaaggaaaacaggtttcaaagtgatgtgtatggccaggcatggtggctcatgcctgtaatcccagcactttgggaggctgaggtgagtggatcacctgaggtcaggagtttgagaccagcctggccagcatggcaaaaccccgtctctactaaaaatacaaaaattagcagggcgtggtggcgcacaccagtagtcccagctactcgggaggcagaggcatgagaatcgcttgaacctgggaagcggaggttgtagtgagctgagattgcgcctctgcactccagcccgggcgacagagcaagactgtgttgcc

SEQ ID NO: 193283 - DNA, 821 bp, Homo sapiens
  Payload ID: 18152
  Gene Name: transmembrane channel-like 6
  ENST ID: ENST00000586126
  CDS Start-End: 472-597
gccgctctgccacctccggggctcagaaatgagagagaatcctgctgcggtcgaattcgggcccagccccgctccaactctcagagggacacacagccacggcctcagtctccccatctgtcaaatggggtgaaagatccaaagggcacagaaagtctggaccggcacaggcaaagaaagccaagacctgctgcaccccgcatccacctgtgcctgggcccaccgtcaccccaaggagagacaattccctctcttctccacgtggcagtttgcccttccggaagagcctgtgtcccaaaccccacagttcctgggactcggcatctgccacatctgactctggatgtcgggggacccccttctgtcttccttcttgtggtccagcctccagtcccagatgggggctccggaggtggcgcccaggctctgagctaccctaggtctgcagactagcgggcattggccagagacatggcccagccactggccttcatcctcgatgtccctgagaccccaggggaccagggctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggag

SEQ ID NO: 193284 - DNA, 743 bp, Homo sapiens
  Payload ID: 18152
  Gene Name: transmembrane channel-like 6
  ENST ID: ENST00000592063
  CDS Start-End: 283-743
ctgcgactggcccagtcgcccctggggccctttgccactcccttggcaaggagagccgagacctcagttcccggcggctcttgcggggcacaggtgagccctggctgcgcgcgcggcccctcctccccggcgcctcccaggaatgggtggtgtggacagctgccaggcgttgaagaccacccctggctctgtgcccctgtctcatcagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctcca

SEQ ID NO: 193285 - DNA, 551 bp, Homo sapiens
  Payload ID: 18152
  Gene Name: transmembrane channel-like 6
  ENST ID: ENST00000592594
  CDS Start-End: 122-551
aaactgaggccaagcaggcacttcctgtgggcccctgagatgcagagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggagg

SEQ ID NO: 193286 - DNA, 1099 bp, Homo sapiens
  Payload ID: 18152
  Gene Name: transmembrane channel-like 6
  ENST ID: ENST00000589271
  CDS Start-End: 243-1099
ggcagacctgcgactggcccagtcgcccctggggccctttgccactcccttggcaaggagagccgagacctcagttcccggcggctcttgcggggcacaggaatgggtggtgtggacagctgccaggcgttgaagaccacccctggctctgtgcccctgtctcatcagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccc

SEQ ID NO: 193287 - DNA, 3640 bp, Homo sapiens
  Payload ID: 18153
  Gene Name: transmembrane channel-like 7
  Uniprot ID: Q7Z402
  ENST ID: ENST00000304381
  CDS Start-End: 131-2302
actccggcttctgtgatgtcagcgccggaacctggaatcccggctccgcgagggaaggccggggaggcggcggcggcggcggcggctggagagggtcctcggcagcctctgaggagcgcggggcgcggccatgagcgagtccagcggcagtgcgctccagcccggcaggcccagccggcagccggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaa

SEQ ID NO: 193288 - DNA, 4499 bp, Homo sapiens
  Payload ID: 18153
  Gene Name: transmembrane channel-like 7
  Uniprot ID: Q7Z402
  ENST ID: ENST00000421369
  CDS Start-End: 559-2400
ttccttattcctgctccctccacaaacgcgtcctcatccaatccagtggaacccagccgggccaaaaggacacgagaactgcagtctggaccgtggtgggtttgtcttccagctgttgaccgagacagtctttcaatagcctcatctgctgttaaatgaaaggatttgagcaccccctccacgcctaacattctggtatgaggtgcctgcctcccggacatttcagccttcacatacagttagaccaacttgaaaccgaattctgccttgtctgtttattgctgtgggacctttgagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaatgcctgatctcgtctaaatctaataactggtgtcatggaattttgagtaaccaaagattcattccagtctcacttaaaaaaataaattctgctgggcacagtggctcatgcctgcaatcccagaactttgggagtccaaggagggcagatcacctgaagtcagaagtttgagaccagcctggtcaatgtggcaagaccccgtctctactaaaagtacaaaaattagccaggcatggtggcgtgtgcctgtaatcccagctacttgggaggctgaggcatgagaatcacttgaacctgggaggtgaaggctgcagtgtgcgagaccgtgccactgtactccagcctaggtgacagagggagaccctatctcaaaaaaaaagataggtgaaaagaaaaaaaaagttgtaattgtaaacatttctgcccagtgcctttatatttatataacattttcactgtgaccagacttgatgatattcaagttttctatttgtgtgtgtgtgtgtgtgtgtgtgtgatgaacacaacgaaaacgtactgcgttttttttcctattataaaagtgatactgaaatatgctaattaatatattaattttagttaaatgctgctaatatgcatacctcttacttgaaggtttttaatatgttttgataactttaataacttcaggtgatgtctgtataacttttaaagtgcagctctctctaacaaatgtgccttacaactcctgattaaacggcgtcttgaaggttttaaaa

SEQ ID NO: 193289 - DNA, 2738 bp, Homo sapiens
  Payload ID: 18153
  Gene Name: transmembrane channel-like 7
  ENST ID: ENST00000569532
  CDS Start-End: 131-2407
actccggcttctgtgatgtcagcgccggaacctggaatcccggctccgcgagggaaggccggggaggcggcggcggcggcggcggctggagagggtcctcggcagcctctgaggagcgcggggcgcggccatgagcgagtccagcggcagtgcgctccagcccggcaggcccagccggcagccggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggtaaggaagcatagctccagagggtcatggctggggacatttacccaggacactgcaaggaaagtgctgttttcctgggagggagtgaaattactgcagccttctctcaccaccacctccccaaaactctgccttgaggcccagccgcgtccagcttcattaattcactgattcatccattccttcaagatgtgtattaagggggatgtggtggctcatgcctgtaatcccagcacttttgggaggccgaggcaggcagattacttgagctcaggagttcaagaccagcctggccaacatggtgaaaccccgtctctactaaaaatacaaaaagtagttgggcgtggtggtgggcacctgtaatcccagctacttgggaggctgaggcaggagaatcccttgaactcaggaggtggaggtcgcagtgagctgagattgcgctattgcactccagcctgggtgacagagtgagactccatcttaaaaataaaaataaaaaaag

SEQ ID NO: 193290 - DNA, 4411 bp, Homo sapiens
  Payload ID: 18154
  Gene Name: transmembrane channel-like 8
  Uniprot ID: Q8IU68
  ENST ID: ENST00000318430
  CDS Start-End: 375-2555
tgcctggcttggcaggagtcgtctgagaaggggactcctccagggacttggtccctaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggcagctgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggcctcttcggcacaggaattcggtcctacttcaccttcctccgcttcctgctgctactcaacctgctgagcctgctgctcaccgcaagcttcgtgctgctgcccctggtctggctccgcccccctgacccaggccccaccctgaacttgaccctccagtgccctggtagccgccagtccccgcctggcgttttgaggttccacaatcaactttggcatgttttgactggcagggccttcaccaacacctatctcttctacggtgcgtaccgagtggggccggagagcagctccgtgtacagcatccgcctggcctacctcctcagcccgctggcctgcctgctcctctgcttctgtgggactctgcggcggatggtgaaggggctgccgcagaagactctgctgggtcagggctatcaggcgcctctcagcgccaaggtcttctcctcatgggacttctgcatccgggtgcaggaagcagccaccatcaagaagcatgagatcagcaacgagttcaaggtggagctggaggagggccgtcgcttccagctgatgcagcagcagacccgggcccagacggcctgccgcctgctctcctacctgcgggtcaacgtactcaacgggctcctggtggttggggccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcagccttgtcctgacggtgtgcgtctcccagacccaggccaatgccagggccatccacaggctccggaagcagctggtgtggcaggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaacccctacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgactttt

SEQ ID NO: 193291 - DNA, 971 bp, Homo sapiens
  Payload ID: 18154
  Gene Name: transmembrane channel-like 8
  ENST ID: ENST00000590799
  CDS Start-End: 383-971
caccaccctgcctggcttggcaggagtcgtctgagaaggggactcctccagggacttggtccctaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggcagctgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggtaggacccgcgcgacccgcacctccccttgccctctctggagccccactgcccagatcggaaaaaggagagtggcatcatcccacctgccttcacccgggtcccccgaccaatcggcccctcccccctcccaccccttccgcccgcaggcaccgcaaacctcgggcccacgcagcacccccaggcctcttcggcacaggaattcggtcctacttcaccttcctccgcttcctgctgctactcaacctgctgagcctgctgctcaccgcaagcttcgtgctgctgcccctg

SEQ ID NO: 193292 - DNA, 433 bp, Homo sapiens
  Payload ID: 18154
  Gene Name: transmembrane channel-like 8
  ENST ID: ENST00000590426
  CDS Start-End: 427-433
ggctccctcaccaccctgcctggcttggcaggagtcgtctgagaaggggactcctccagggacttggtccctaggtccccaggtgagctggatgtccagtggagggagaatgcagaggatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgc

SEQ ID NO: 193293 - DNA, 3927 bp, Homo sapiens
  Payload ID: 18154
  Gene Name: transmembrane channel-like 8
  Uniprot ID: Q8IU68
  ENST ID: ENST00000589691
  CDS Start-End: 561-2072
cctggcttggcaggagtcgtctgagaaggggactcctccagggacttggtccctaggtccccagatggggagactgaggccgtggctgtgtgtccctctgagagttggagcggggctgggcccgaattcgaccgcagcaggattctctctcatttctgagccccggaggtggcagagcggcagacccgggcctcttcggcacaggaattcggtcctacttcaccttcctccgcttcctgctgctactcaacctgctgagcctgctgctcaccgcaagcttcgtgctgctgcccctggtctggctccgcccccctgacccaggccccaccctgaacttgaccctccagtgccctggtagccgccagtccccgcctggcgttttgaggttccacaatcaactttggcatgttttgactggcagggccttcaccaacacctatctcttctacggtgcgtaccgagtggggccggagagcagctccgtgtacagcatccgcctggcctacctcctcagcccgctggcctgcctgctcctctgcttctgtgggactctgcggcggatggtgaaggggctgccgcagaagactctgctgggtcagggctatcaggcgcctctcagcgccaaggtcttctcctcatgggacttctgcatccgggtgcaggaagcagccaccatcaagaagcatgagatcagcaacgagttcaaggtggagctggaggagggccgtcgcttccagctgatgcagcagcagacccgggcccagacggcctgccgcctgctctcctacctgcgggtcaacgtactcaacgggctcctggtggttggggccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcagccttgtcctgacggtgtgcgtctcccagacccaggccaatgccagggccatccacaggctccggaagcagctggtgtggcaggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaacccctacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgacttt

SEQ ID NO: 193294 - DNA, 2500 bp, Homo sapiens
  Payload ID: 18155
  Gene Name: transmembrane epididymal protein 1
  Uniprot ID: Q5T9Z0
  ENST ID: ENST00000367565
  CDS Start-End: 132-953
gtcctgagtattgctcttcacgcttcagtcggacaggcctgtattccatgggaaagtccattggccatttttaactggggctatttcttttctcttatggactatatcaggccacagtggtctccaagggcatgatactcaaaggttgtctcctgtatcctttgtgctctcccaggaataagcaaagatgtgccaggctgtggaaaatagcctatggaggattactaaagatagtgactggctccctcttaacattttatgtggttctctgtcttgatggcgggatggtgctcatgaggaagcaagtgccatcaaggttcatgtaccccaaagagtggcagcacctcaccatgttcatcctcctcactcttaatggctgtgtggacttcatgagcaagaatgtgctgcctcagaggtgtgtgggcctagaaaaaggtaccctggtcctgatcatctacgagctcctgctgctgatggtgtcacatgttaaagattcagaaggggtggagctgcacgtttattctctgctcatcttggtggtgttcctgctgttgctggtgttgactgcagagctgtgggctcccaacatgtgtcatctccagctgatggagacctttctgattctgatgatgggctcctggctgatgcaggcaggctttattctatacagacccgtctctggctacccatggcaggacgatgacatcagtgacatcatgtttgtcaccaccttcttctgctggcatgtgatgatcaatgcctcattcctgttgggaatctatggcttctcttccttttggtatcattgtttcagacccagcttgaagctgactgggcccaaagaagctccatattatgcaagcactccaggacccctctacaagttgctacaggaagtggagcagtcagagaaagaggaccaggctctcctccttccaaagagctccccctgagacagggcctacagtggctggcacatcgtccacctcatcttcctcctgttggctcctcagccacgagcatggtaccctccttggtaaaggtaatggccttgaaggctagcagttggtcccgtctgctggttcattttcttttcttctcttttctttttttttttttttgagacagagtctcgctctgttgcccagcctggagtgcaatggcacaatctcagctcagtgcaacctccgcctcccgagttcaagcgattctcctgcctcagcctcccgagtagctgcaattacaggagcctgccaccatgcccgtgctggtgcattttctgtccctgagcctctaattactgagaagataaggggagagggattgagaaagagacgctgatgggatttgcgggagggagggaaaaggacgaggagaacacttcttcttagtgtgcaagaaaagccactgggggaagagaatgcaacaaaaggaagagctgtgaagggaggagaacagagtctagcagttatgctgtcattagcgtcatcaggcacaagggattgccttttacctgagggaataaagacttctcacaactcaaaactggacccattcaaatctcatcttgataaagaaaagtgggtactttacgtgctcaccaaagtggtgccaccatgtggaaatagcatgatagaatttataattaattcatacaggctgaaattatgctcgctttgcctccttctctctccgcagctttcaagaattggcttcatttcaaactttacatataaagtgagactttttaaatacttaataacatttcaaatttccataatttaaatttgtatagaattcaactgctatagcatttttatagcattcaaatgcttggtacttccctgacttctcattttattactcttattctagcccaaactttccttttcaccatgaccacccttgcacatgcaatttagcagataccattcttgggtctttgcaaatttcttttccttgcaaatcacagccagtcatcctacagtcacatatttaccatgttattcgattcccagaataaacctacatccacccccacaccgcaccaagtatccccaaggtggccttctccagaactcttactgattcccttgttttggaactcttgggcacttacattaaatctgctttgttagtttgctcatacaggtgacccactttcttttatactgctgctgaaatcattttctttcagaaggttcttcctcacccactaaagtacaggctcctaaagggaaaagactttgccttatccaagttaccaaatttcctatgtatactccagctatggatcatggttatgtttaataaagccttctttgcttccagagtcttccctaatcctgtttcttctaaatgtattgctggacaggttggaggttttgtgaatctctctgggtgacaacaacagtcctgaacactgagtcactgccttagtaatgcacccactctcttccttgttttggggtataataaaatccagtaacttgtttctgaa

SEQ ID NO: 193295 - DNA, 1824 bp, Homo sapiens
  Payload ID: 18156
  Gene Name: transmembrane inner ear
  Uniprot ID: Q8NEW7
  ENST ID: ENST00000326431
  CDS Start-End: 156-626
ggcggcgcgggaacctgacaccgaggatgaataaatgatgctcgctgactacccgtggccaaagcccgtggccaccgagcgccggctggcaggggcagtgaccggcggccggcccgttcgtccctgggctccgcaagcggcgcggtggcacgaagatggcggggtggccgggcgcgggtcccctctgcgtgctgggcggcgccgcactcggggtgtgcctcgcgggggttgccgggcagctggtggagcccagcacggccccacccaagcccaagccgcctccgctgaccaaggagacagtggtgttctgggacatgcgcctgtggcacgtggtgggcatcttttcgctcttcgtgttgtccatcatcatcacgctgtgctgtgtcttcaactgtcgtgtgccacggacccggaaggagatcgaagcccggtacctgcagcgaaaggcagccaagatgtacacagacaagctggagactgtgccacccctcaatgagctcacagaagtcccaggagaggataagaagaagaagaagaagaagaagaaggacagtgtggacacagtggccatcaaagtagaggaggatgagaagaatgaggccaagaagaagaaaggagagaaatgaagacatcctgggcagcttgggctggcgggccctggagctcaagccgtggccggggtccaggcatgttggactctgagctcatttggggaccacagaggctgtggtcagagagggaagctgaggcccatggccacatcctcatggcccatcaggggcaggaaccagacaatctcgtaggtgtcctgccccccagcctaggcttggctcctttcaccccatccacatgggtactgtctcggcagaggtggtctggtgccaccgtccctctgcagatacactgctctccccacccagacctgcctgtctcccaccctttctgccagggatggcagtggctgtgaaggagtaatgggatatggggttacttcagccaccctttctggcacgaaatggctgaagtgcatgggtcagggtgtgaggccacacccagagtagccatgaggaggcagagagggtcactgggggacactgtggcagcaggagggactctgtctggccagggaggagccccagtggtgagaagacttccccaagcctggcaggggatccagctcaagggagtaagtagaggtggcttcagaaatggaacccccagcccagcagacatcaagctcaaggcaatgggctaccctcatttcacacgttgtgatgaagctgaggctgctgccaggcccggcatgaggccccgaggctcgagctcggggctgggggctgcagggctgggtcaggggtacacagagctaaggccaatgggctagagggtgccggaaagagagctggagtctgggctcctcttgggaatcagagtatatttaagaagccaagggggacctcgggctgttctggtggccccttctatgcccagctgtgctgggaggtcccagggccctagaagatcacagcagggccttctgcctgctgaccataacagtgccagcttctttgcagcttcctcttctaccatttcccactacgggcacctaaaagaagcatctctgaccagaagacaaaggcccaaatagcacctgggggagggaagatgcacagaggcacttccagatggcatcgaacagactaaggctctgaaacctaggcctgaacactaaggtctcgagacaccagaggtttctgagccaggagagcctgctggaaaagcagcctgcagagatttgtgaataaagctgattgccttctcaga

SEQ ID NO: 193296 - DNA, 1340 bp, Homo sapiens
  Payload ID: 18157
  Gene Name: transmembrane p24 trafficking protein 1
  Uniprot ID: Q13445
  ENST ID: ENST00000214869
  CDS Start-End: 100-783
atacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatca

SEQ ID NO: 193297 - DNA, 541 bp, Homo sapiens
  Payload ID: 18157
  Gene Name: transmembrane p24 trafficking protein 1
  ENST ID: ENST00000588289
  CDS Start-End: 283-531
ggaggcggagccaaccaggggcgtggtcaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccat

SEQ ID NO: 193298 - DNA, 713 bp, Homo sapiens
  Payload ID: 18157
  Gene Name: transmembrane p24 trafficking protein 1
  ENST ID: ENST00000586835
  CDS Start-End: 1-197
aggaggtcgaaggatgggcagaggctgtggagcccgaggagatgctggatgttaaaatggaggacatcaaggtgtgtccaggctgcgctggggccactccttccagatctctaggattcacctggggtgccccccttgggctgacccagcctcccctccgtagttgtgccctccaactgaattatagagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctccc

SEQ ID NO: 193299 - DNA, 578 bp, Homo sapiens
  Payload ID: 18157
  Gene Name: transmembrane p24 trafficking protein 1
  ENST ID: ENST00000589638
  CDS Start-End: 5-578
ccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacaccaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgc

SEQ ID NO: 193300 - DNA, 616 bp, Homo sapiens
  Payload ID: 18157
  Gene Name: transmembrane p24 trafficking protein 1
  ENST ID: ENST00000588259
  CDS Start-End: 11-235
ggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccagggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaaga

SEQ ID NO: 193301 - DNA, 809 bp, Homo sapiens
  Payload ID: 18157
  Gene Name: transmembrane p24 trafficking protein 1
  ENST ID: ENST00000591695
  CDS Start-End: 128-685
actcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacgagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtag

SEQ ID NO: 193302 - DNA, 717 bp, Homo sapiens
  Payload ID: 18157
  Gene Name: transmembrane p24 trafficking protein 1
  ENST ID: ENST00000591157
  CDS Start-End: 59-346
gggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttgggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccat

SEQ ID NO: 193303 - DNA, 4127 bp, Homo sapiens
  Payload ID: 18158
  Gene Name: transmembrane p24 trafficking protein 10
  Uniprot ID: P49755
  ENST ID: ENST00000303575
  CDS Start-End: 53-712
ccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaacc

SEQ ID NO: 193304 - DNA, 1161 bp, Homo sapiens
  Payload ID: 18158
  Gene Name: transmembrane p24 trafficking protein 10
  ENST ID: ENST00000555873
  CDS Start-End: 19-480
gaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagcatagtgtctcagaagaaaaggtgtggaaagataatacatcaagtttataagcatctttacctctggaaagcaatgtgggaattgaggaaccatgaagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttt

SEQ ID NO: 193305 - DNA, 2560 bp, Homo sapiens
  Payload ID: 18159
  Gene Name: transmembrane p24 trafficking protein 2
  Uniprot ID: Q15363
  ENST ID: ENST00000262225
  CDS Start-End: 107-712
ggagcttaggcggcggtggctgagaaggcagcggggcggcggcggcggcggcggcggcggctgtggaggccgcagtccgggtcctggcttcggcctcagccccaccatggtgacgcttgctgaactgctggtgcttctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacagtattctgtgttttatatattgacagctaatccacattttttacacaccaactttctgttcttatttgacatgagacatgttcatgttttctgagtatttatacctattacgtctgttactttttaattctataaacttgaggatagtgaatggtaccaagttttagtttctgcgtaggttttccagtgtggcttctctgatggatcagtgctaaaatcttaagtatttttctatttgggaaaaaagggttgaattattttcacttgcccacgtagtttatgaatgtgggaaatagcttcaaagacagattaaatgatttgcccaaggccacagaaaagagtgaaaggtggaaccggagactagatcaccacctgtagaaactgttcttcctctgtgaaactaacggcctgctggtaataaaagtagctaccattt

SEQ ID NO: 193306 - DNA, 603 bp, Homo sapiens
  Payload ID: 18159
  Gene Name: transmembrane p24 trafficking protein 2
  ENST ID: ENST00000438031
  CDS Start-End: 105-603
agcttaggcggcggtggctgagaaggcagcggggcggcggcggcggcggcggcggcggctgtggaggccgcagtccgggtcctggcttcggcctcagccccaccatggtgacgcttgctgaactgctggtgcttctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaaggtggtggagatacctgggatgctcaccagaacaagctagaagaaatgatcaatgagctagcagtggcgatgacagctgtaaagcacgaacaggaatacatggaagtccgggagagaatacacagag

SEQ ID NO: 193307 - DNA, 1975 bp, Homo sapiens
  Payload ID: 18159
  Gene Name: transmembrane p24 trafficking protein 2
  ENST ID: ENST00000509052
  CDS Start-End: 1261-1611
gattaattgggtctaaggagtttccatttgacagtgtactcagtagggctgggcacaagttacacaatacaagtgaaatccaaaaataaggggataacggaagggagagactcttacacttagctaagaatttagcgatcaactattacagtctcgaagttatgcaagtgacatgcactttgaaagagcgactgacttgatcacagcctaacagctgatttgtagcagactgggatgagagtttgggtcttctcatttccaggctagtcctttcccctaagccttcaggcatctcagataaagcagaattccttcactgtttggcagtaatctggaaaaccttgaaatgtgataaaaattcatcttgtttatattttaaaaaaccacaaacgtttattacctcatggtttctgtggccaggaattatggagaggcttagctgggtggttctggcttggagtatctcatgaggttgcaatcaagatgtcaaccagggatgcagaaattctttattttaaagagatttcttttttcttgagttttgctatcagtcacagttccatgtttgttggtgatattaggccagttagagaccacatttaaggtgagctttctgtttctgaggggtttaataaggataaataagacataaatgtcaggacctaaaggtgttttagaaagccatgaagtcaactcttattttataaagtgggagaattgcagcccaaaatggttattatcacttaccgaagtgaagctaagtgaaagttacatattcttggtgaatttcttttttttttttttttttggaccaagtctcgctctgtcgcccaggctggagtgcagtggcacgatctcgactcactgcaacctctgcctcccgggttcaagcgattttcctgcctcagcctcctgagtagctgggaatacaggcgtgcgccaccatgcccggctaatttcgtgtttttagtagagacggagttttaccatgttggccaggctggtcttgaactcctgacctcaagtgatctgcctgccttggcctcccaaagtgctgtgattacaggcgtgagccaccatgcccagccatattcttggtgaatttcttactgccattagacattacttataaagtctatgacttaatcttttgtgacattttatgcatttctctcttgcctccagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttacta

SEQ ID NO: 193308 - DNA, 1475 bp, Homo sapiens
  Payload ID: 18160
  Gene Name: transmembrane p24 trafficking protein 3
  Uniprot ID: Q9Y3Q3
  ENST ID: ENST00000299705
  CDS Start-End: 189-842
aaggtgcccgggcccactttgagcgcgcggctgcgcactgagccgccggccctcccggaagcgcagagctccgctggtgccacgtctatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctggaga

SEQ ID NO: 193309 - DNA, 16555 bp, Homo sapiens
  Payload ID: 18160
  Gene Name: transmembrane p24 trafficking protein 3
  Uniprot ID: Q9Y3Q3
  ENST ID: ENST00000424155
  CDS Start-End: 106-627
gtctatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagagattcagaggagcttattggaaggaggtggacaagatggtcgactatatgcagccaggcggaacacctgccaccgagggactgggacgactggcaccctcctaacagattttcagcggggaggcactgagagtggatggagggaagacacagaagctacgctgaagtgggaggaagctgctgcacagagctaccatgcactgggactagctcctggtccccagtgactccaggggaacaggtgagttaaactggcaaggaacaacctgctctcaccacaggcctctggaatcccggcaggaggagactccttgaccaccacagacacttgagctggcagggagagttgcttggagaagtggtaggggcagcacttcagcctgggtggagcccagagggtttggtgtgggagcatttgcaataaagcatagccagggacagccatccctctaggctcgacttgctcccatggcagactttaaccctagggggactgttgaaactaaattcttcagggtggtcttgcctgtcagatgaggccagttcaataacctgagcaccccttggttttctggtctctcctggagccccagactggccgtgcctgcttgcagtgcagccttgggtagccctgggggcccgcatcacagctcctgtgctggcaaaccacaccatgtttgccagtgcagtagctgtgatgcgggcccccagggctacccaaagcagaaagctccagcacagcagcccctatggacatgcaccagcccagccacttccttcctctactgcagtttccgctgggcccatggccatcccccccaatcactgctggtgcacatgtgagcaggcagatcttgccttctctgccctgccagtgtgcatgtgtgcatgtgccctgccctgccactgctgctggcatgagtgaactcagcctcctcctccccacaccatgccatcattgcagtcaaagccttggcaggcacagagtccaccagcctcaccttcaccagtgccttgcccctgcactaacactgctgctggagtgaaactaggcagggagaacagtggacttaccacaccctgagcagccacccttgcctgcaaaaactcagacagagggtgcacgcagaccagcacctgccagtctcccgctcccatgctaacaccactaccagcgggacagcatgcgaagttgccattgggcgtgaggggcccaccttcccatgtcatgctgcctccactgctgctgccaatgcccacatggaggctggcacctgggcaccccctagcaccctgccatagccaatgagcatgcaccctgctgcgctgccactgccactaccactggcacatgtgaatgaggacagattccactgccactgccctacaaaatgctttggctggcaccacccattggagtgttgtgaccagcagtcagggagcaccttggctgcacccagcacagtgggttcctaaccttgaggagccagagaacgaagttgggcctgataccaatcccctagggttagggtatgcagtctaggagttggaagcctagctttggctccctgaaattttccagaaatgaagccagtcatttgaactcatcttataacacaagcaaaccctcaaggtcatcaaataggatacaagagaaaaaaaaaccatcccaaggacagcaacttcaaagactgaaggaacatcagtctgcaaacatgagaaagacccagagcaagaactctgaaaacacaaaaaactagagtaccttctttctccaaatgaccacactagctctccagccagggttctgaacccgcacatgtacccctaaacttaaaagatttttaaaaaagagattcagagaaggactgtagctgtggacccaagctcccttcaaagcactggcaggtcaatcgtttgcaacgcagacagctgtatgtagagctctgtgatccacccaattattggctcatcaaggagtgtgccacatgccagatgctctgcagaacccaacagaggggttgctcctccatggaaacaacaagaagctttgatcaaagagcctgtattgactccttcagtgaaattcttgactgaaataatcaccttcttaaaatacacacatggtgaggtttgaagaggggaaattgccatccaggtaagaaaccttggccttgtcccaatttagtagtgctgaaggtgtgttcatttgaacatagatcatgtgctaggtactgggaggatacaggaatgagcatgggaataaactttacatagctcttgttcaagcaggaactttacaatctagttagaataaagaattatctgtgagtcctggttggacagtgtgtatcccagcactatctaggggtaaggatgccttcataccaacctcgtcatgactgtgctaagtggcaggtctgatttggttatagaactggatacatcagacagttttaactttatgctattaaatatttgaacatatcactgtgcactatgatggatattaattgtttatggctgtctagcacctattccaccttctactgaaaatggcagccagcttttacttctcttctatgggatactgtctagggggaggtggggtatgtatttaattagatcttgcctttgtctagttgtgaaataggacacactaggctactgatacacccattccctgaatgttaatgatatggaaagaagcaaagggactgaaaatgtgggatgcctgcatttgttgctgtcagatatttgttatgtgctgtgctggggtttcctgcctttctttctctcctggaagcaacactacatccttcctataacttctctttcaattcaagatagccagtttcagattctgtgagtgcacacaaagagccctaatatataggttaagatccctgtgcactgaattcctcctaccaagcaaccttctacttacatgcatgttttcaatctttctattcccatgaacatggcacacaaaaaattctcaatgatttttgtggaacaaatgaatgagtaaaccacaagtacagaaaagtagtgatgtgtcaggatatgtgatgtagtcatggttgaaactatgaagaggacagaaagctgtaggtaagaggcaaaccgggggagaagctaaggtggaagtgtagctggagctgagttttgatggctaaatatggtttgaatggatggacagggaggttgaggtatggagataagaatgaggatggtatagctaaaaagaaggcagttttagcgtggttggagatgtaggtgacctccttggaacagtcacctgaatttcataaataattattgagaaggtattgtgtgcttgtaatgtgcctagaggggcacttgggttcagagatgagtaagacccgatcaaattggggtgggatgggggaattaacctggagcatgcagataattatagctcaaggcataatgcagtgagcactccaagacgggtacaaaccagcacccttaggtcctcaaggggtttggatcttgagcatgtctaatctgtgataaaatgcagagctttccagcaaggttaagaaaagacagtcacaaattttaacaatgggcctgtgttcagcgaccataggttgaatctttgaggttgtccatgtcaagataaggaataaacagtgatgctgtgttgggttcctcatgcagatgtgggaaacccagtgaggtgtcaggataagtttcacatgggggaaagccctacaggcctccagggtgaggggccctgccaagtaggacagagtgggaaagcacagggtgctcatggggaaccaagagttgctgttagtctggaatagggacaggcacacccagagactgataggcacctactgaaaggtcgtgactccagggctgaggggtcctgcatttaacaatgtcagccacagggagccacaggtcagtggctggatgagaccatatgtcatttctaataagtcaataaatgtgccttctcaatatcctccaaagcacgaaggagctacagattacccaacttgggccttttaatcttatttgcaatttcttgatcgtatctgttaatctgatatcaggagggtattattatttttctgccaagggtggctgaattcttttgaagttgcagaccaaaatcggtagtagttgcggtaaaacctttgcactgtggacctagttttgggaaattacgtgatgaatttggatgagggctctacttgattggattgtgaacagaggcaacttacagagggtgcattcaggccaggttccttagggctggctggatctttccctctacatcactctaggggctcacgtctgagtgtgtcaaagccataacaaaagcagcactcccagaaaaggtcaagaagcatgaaacagaaattttaattacaggcctgtatgctgagaacatagagacctggagatagctcaggggtttaacaaacaaaattcccatggtgtggcaggaaaacttatttgtgtgtgtttagtaaggcaatacttttaaaaaattatagaaaaaatcatcaactattactttcccttctgctccataccttccaattcttgttcatatgccaaggtagatattttctttgttgcaatggtaatacacagtatatgattcctttgaagtttttgttcacatagcgtatcttaaatttgtttctctttcagatattaatttcattttagtggtcgaggaacacatcatcttagtgaatatagcatacttttcaaaattcttttcttaacaccggaaacttgtttctatcatagccaaagctgccacagacaccactatggacagctttcagaaaatgtctctcttggcttcctattctgcctttttataaatcagtcttaaagttatcagttcagccctgaattggcagctggtatggaaatttcttgcctggcacatctggaaaggaggggcttgtttgtgatcgaacagatttcttggccaaaaatattggccagccaggatccactgcccattatgagaaattcctagcttgccagcaatgtgatctctttccaggggtcgtaagtctcatcttaccaggacagaaccacttcattaataatggcaatccagtctgatggggccattttcttcagcttcatggtagtgtagagatcttcaaacatcttgtggagtttgatctcttcaaggcaaatacagggctgagggggaaactcattatgcaaataatctgagctattgaagggcgttagaatagcaaacgggaaaagtgagactaaatctaacaatcgacccctgaatctgagtgccacaaattcacagcagtcagcgaggcaggccgagatcatggtggctggctgaggaacaccgtggttctaccttcttagcttgcaagaatacccagtctctaggaccattgactcccaatcagcatatggtaaaagaggccattagtgtccattgtgacctctgctcctcctctcagcatcctcactacatccatttggacacaggggaggccttgacaccagctgacaatgagccctttcctcagggctctggaaaatctctaccttcccagggatttgtgaagttttcttttaggcagacagctgccaggcgtcacatgtgcaacacaggtaccgtgagctcacctgactttgtccacccacagagagggccagcaggctccaacacaagcaggtactctgtccaagttcacttcttggcaggaggctgctttcatcttctctgcccactcagacatagggatttgagttgcaaatattgccaggttcacatagttcaattacacctccttaacaatcacaagaatgtagaatacacagtttaggaagctgttaatgtaagcatctgtctattaaattgcagatagttccaggcatcactgcaggatgagtcttattaaccaaggttaataatcctttctaatcagcacagtatttctccactagcggtgggcttagaaatcatctatggcacttgtaaaatatgtggatcccgaagacgggcttctcctccaaagctgcaggtcttcctgctgaaatggcttgttagtgtctgactttgtgtggtaaatggtacctgaaagggcttcctccttcattaattggagatctcctccctggccatctcctgtgtcttccatcagcttccctgcatcctttttatgaggctgcagcagctgtggttagaaatcatctgtttgctgctgcagaaccagagtttctctgttttactgtttgatcccctctgcagtgtgggctcttcgctcttccatctttaaaagtatggagcaaacgcacacagcagggccaaagggaaagcagccaggcttagagccatcaagaggcctgaccatcaggctatttggtttaatgctgtggattaaaagttggttcctggtagatacaaaagcacatgttggaaatgcctgcagagacttgaaaaatagctgcttcttaaggattttgaacacgggcttggccgtgctgttgacactgtttatctgcactttccatgaagccacgattttacgaagcgaagataaactttggtccagttacggaattatcatacattctaaatgagtgtcatccaagttaatgacaagtaaaactgtaatgcggagtgcaaatgcaaggactgggaaaaggtagaattaatcacgtgattctccttggagataaaggatgggaaggctgtcagttgtttatgggaatcccagcagaaagccccactcctttgatcacacacagctgcatttaaggcagaaatgtggaattgcagactagagagaaatttaaagatcatcttgcccagatcttccatttataggtaaaaaaatgaaatcagagaggtgaaatgtttgttcaaagtcacagagcaaagctattaagagctaaaaatagaagttatttaagtaagatgtttaggtgtaaactgtcttttaaaaacaccgctgtgaagattgatttagtggcattagcatggtttcgcagtcccctgcacccactctgcctatccacaaactccatagaaatgatataaaataatgttttgtaagctattcacccttggaaaccacattgggtactctcagtgttgaatctgtgatgggtccttgaaagatgacagcagaaagccaccaaggaaagccctaagatagcagagggaaggacagctggggacaccataagtgaacaatttgggacagagaaatggggataacattgaggatgctctttgtcaaaaggtggcaaaagctgggggcaggagggagcccgagattagcagcaggaatgctgttttcctccagccggaagagtgggtatagatgcttggactggaaaggacaggcagggccctgggagaaaaggggacactaatgcccagatggacagctgccctaggagcccagccagctggcctcactccatgagcgcagtgcattctgcaggggtgattccttcatcttctcccagcccagcaggagatccactaactgagtcttggctaagaaaacgagcctgcaattaaaggcagcaaacatttgcagagagcaaaccccatgtaaatgagtcaattcatccaaacaaaggaagagtttaattctaaaggaacacatcgaccctactgggacttcagatataatgtgatgggtgttggttcatgcctcggccataggctacccttcttagctattgtggggatggggagcggtggcatggtgagagggcaagacctcgcaggaaaagggatagcagggaagctgggaggcagagtatttcctgccccgggattattctcagactgagctgataaggtgggaactaactaatcaggggagccctggaatagtttctggtgtcctggaactctcagaagcctcatgactcaagatagtctccactgatatttaaactgaagtggaccaccaccagtgtcagatggtgccagacttcaagtgggatctgaatgggcttggactttgcagttgctgcctgtgactgtccactggccagctgcgtgggtgtcccccagcatgccctctagagataccaggtttctttttctatctagaaatgactgcaagtggaagctggtaacatgtaaccctttatgaagaggggactttgctgtctatgtgcaacagcttcatgtcctctctccctcccccagacagcacatagttaggacagaagaaagatattttataactaagaagatcttggaaatgaaaacatgaatgctaaaataaaatgttcaataaacgagctgaatagaatgactagaatcaaagagtaaattaataaaatatatgactgaactgaggcattctctcaaatcatggtttaagagagaaaaaatacatagcataaagggaatgttcggagacatgcaggatgaatccaaaggcccccaaatctacttaataacaattttagaagaagagaatagaaagaatggtggtgagaagaatacaagatctgagaaaaaaaagcttaattgtctacaaccatagaaaagattgaacaggcctactgtttaccaactagggtgaattaaaaaacaaaccaacaaacaacacctgaacaaattgtagtgaaattttaaaacatcaaagacaaagaaaattctttaaaattccagagaataaagatagactattatgtatgaatgaaaatcaaatttgtctcagtaacactaggtggaagaagacaatgaggaaaaatctttaagatgctgagggagggaagaagaaaacttttgatgcttgaatgttatatccattagattatcattctacagggagaacttaatatacacatttttaataaggactcaggtaatttgcctacatcattaggcaatgtgggtgttttatcgagcagtgattctcagactaactgatgtgaaataccagtattttaaaaaatgtccaatttactcaaatcaatacttttatacagtaaaataagaataaatttttggaaaaataattacaggaattacaaattatcgcaaaagtaattcagctgtaggcttgggggaaacttggtggtccctctagagataccaggcttcttttttatctagaaatgactgcaagtggaagctggtaatatgtgggcactttgtaaattcatattgagtaaatgaatgaaattgtgacttcctgagaattgaaacttggtttcctaaccctaattgatatgaggcgaattgctctatggtggtgtacaaactcacctgaaaaggacttttatagacaaatcttcatgacctgttcttgccccagttcatcacctcttttacaccaaaaggcctacagggtgtggtcactgtttcttttgggtcattttggggtggaaatggtggatgtaatgaagccaataattcaggacttaattcctttcatgttgtggttttttgctcttgcactagagtacgaaatagcttccaggagctccagctctaagcttgaaagagtctgtatgattgtaatcacatggtgacgatactcagaatctacattggacttctgttgtattctcatcactcagtttatcttttagcagtttaataggtacacttcagggtcttccattttgtgtggaattaaatcctcctcttcaaatgctgtaaataacatcagttaaaataaaacttgaataaaatattggaaaaaagtaatgcagtaaaaaaattacagtaacaaaatagacacacaaaaatataagccagcattgtttattattaaattcaacatacataaaattactctgtcaaagtgctatgaaagtttctgaatacttaccctgatttgtgaatttctgctattgtgggcaggtagcagtttgtgggtcagcaccagcctaggatgatgatagtgacctccttatggagggcacagtgacctgcctgaagatctatccagagtgagcagcaaaggaaggacttgatctcaggtcttctccctccaggtccaggaggtttttgatcctcctgcatctttgccactgcacctacctgaaacctgtctctctcccttcagccacagcaggaaggtgtccctgaggtgggcagtagatctctctagacacagcagtcaagctccaattgaacacctcttggatttgaatgaagttctagggtaaagggatgaagaggtcatgccacctccccctactcttagaaatggtctccaaaggggcaaaagcagttcagaatccatctttgatgaaacatggagtaagtgaatgagggaggggcttccaaaggcagtgaaagccatatgaatgctaggggtaaaggaagacaccagaggggacacctgcccacctgcctgtacaaatcccaggcaaagcgagcacttctccagggaaggcaacatatcctcaggccaaaacccggaaatgccttgtttagaggaaagggaaaagggtgggtcgcctggtggtgggaacttgcctgaagctagtttgacgtggagagaaatagtgggagtttgagtggatggagacacattgtatatgcagtcagcagcctgttgtcaaggtggggtaaggagagagactgcactatgagcagccggcaggagctggcctctgcaaaggaaaggaactaagtgaatgctgaaacagcccccatccccagtgtctcacctcatatgaccttgtgaacagagagggggtctgccaacctccagtgaggccccagccctcatccccaaaccttcagtgaataacttttctcaaggagtaagttcttatttgttcacagtcaggaggcaccactgtaaaacatcccttctgagttaaaggcttcagatatgcaggccaggcgtggtggctcacgcctgtaatcccagcactttgggaggccgaggtaggtggatcacctgagttgggagttcgagaccaacctggccaacgtggtgaaaccccgtctctactaaaaatacaaaaaattaggcgtggtgatgggcacctgtaatcccagctactagggaggttgaggcaggagaatcacttgaacccgggaggtggaggttgcagtgagtcaagattaagccactgcactctagcctgggcaacgagagtgaaactctgtctccaaaaaaaaaaaaaagggtttcagatatgcagagacaatatcactcagaaatgaataacaagatcagaaagagaggaatggaaaagaaaaaaaaacaaatggcaaatgaagaacattcactggaaaaatgttgccacaaaattgtgccaagtagatgccacagttcaaaaagtgtaatgaagctgccacttgtatataactaaagcttaaagggcagataagagagaaggtgagggaagtttggccagaccacagaagaaggtaaaacatgggcaggtagaacaagaggaaataaaaccattgcagaactgaagtctcagttggaggagagtgtatattggtgtaacctcaagggaaggtaaaatttcaatattgacaaattaaaatttcatatgccctttgattcagcagttccacttttaaggatttatcctacaggcatttccttgcaaatgtgtgaaataatatgttcaagtctgttaattgtattgacatttataacagcaaaacttttgaaatgacctatatattcccttatagagactcattaaataaattatggttatctctacaatggagtattatgcaaccataaaacataagataactgcatgtgactctatatgtatctcaaaataaaaagcttaattaaaaaataataaggcagccttataaatactgttagagtaatctctaaaatattatgttgatggtgaaacaaattaacatgtaagataatgtgtatagaatgttagcattgtataaaaaaataacagactatgctgaccttcttttatttccttagtctatctctggagggacatataagaaactggtaaagcagttgtctctggacaaggaaactagctggtttcttttgagtgttgtaacattttataccattgtattattacctattcaaaacaataaattaaacaatttatttaacaataaccgacactcctatggctcctctatggcccaccctcttcagtgtccccacaccatcctgcactccctggtcaccctgagttataaggactttcttggcatctgcctttcccagtggacagtgagacttttgagggcagggactatgtgtcactcatctcagaatggtataaacattcaacacgtaggttctagaattaggctgcctgggctgaaatccctgctccagctcttcttatctttgtaaccttagggaaataactaaacctttcattgcctcaatttttcatccataaagtgggaataatggcatgacctgccttataggatttttgtaaggattaagtaagataagtctcagaacacatacctggcatgtaacaaattctagataattgttagcttctgttgacatctctgcattcagatgcagctaacagagggcctgacatattggtagcactggtgttttcacagaatgaataaaatgcatgccaccctgtgatctggtgctaacagagctatctttcttctgcttagctggtagataattttggatgattcaagctgtctaccaacctaacatccctgacatcatgaaggaggtggttatttcagtggaaacctggaggcatgcccatcaatgccgaccctaaaaatatttttgtttatctcagtgatccagataactccatggaaataatgggactctcagaatgaggcttagttaccagacattcagatagagagaccaggctttatctgatcacaaaatagcacctgaagcaccagcaatcccttaagtacccttttcgattgagtttcctttcgttgaactttccttttcaggcaatattatttaggtatgctgaattgagatctaattctttttgaagttcagtctagtggagaaaatgttagaacagcattagagaactcccactctctgaacgacgtggtgaagtcatttcattcacagcactgtggctttcttctcccatctgtcaagtcatgataaaataacaaataaaccaaatccctgctgcagcgtgaggatattataaggttaatgttaagcttgggctgggaagtgcccagataaaattgcatgaaagtacagagatgattctataaacatgtgctgagcacctattatgtgctgggtcttgcatttagttgtggggacttgaaaatgaaagagattcatgctcggtaatttttacaagaacatcgaactcacttggcaaatatttactgagcccctactgtatttcaggcactgttttagtgcttgggatatatcagcgacccaaatccacaaaaattcattcttttgctttccaagtcacttggatgttattggatgcttgggtgctgtggagaagaaatagaaggaaggcctagatacttcttcccaggatgcaagtttcaacactcatgtttcaacaaaaacaatgacatctataaattatataagcattagtgtgcaattattgtcgtaaaaaggaggagtcatggttcttcttttgtttgtttgtgtttttttttttatttttttgagacagagtctcactctatcgtccaggttagagtgcaggggcaccatcttggctcactgcagcctctgcctctcaggttcaagctattcccctacctccgtcccccaagtagctgggactatagtcatgcgccaacacgcccgactaatttttgtatttttattagagatggggtttcaccatgttggccaggctggtcttgaactcctgacttcaggtgatctgcccacctgtcaaggtgctgggattacaggcctgagccaccgtgccaggcccatggttcttctttaacaatgtatataactgtcatcccatttgaacactgcaagttaataggtgactgtaagttaaatggtaatgcccaaaatatattgatttccccacttacccctgtaccaggacagcatgtctcattcctccctcacctcacatgatgaaattagaatctcaaaccatggacaaagctcctttcccctctccactgtttcctcctttatctctcattcatggcagctcaaccaacaagcctcactcgtttggaggtaaaaattggcagccaggatgactggggactcttccccagacatccaggaatccttgagcattggagtggcaaaggtctctaggaaacatatggtgtagcctcttcattcgacagctgaggaaacagaagtccagagactgcagtgccttggccaaggtaccagagccagacacgagagagccgggcctggaacccaagcctcctgcctccttggtcagtacaccacactttagcccctgtgttgtacaataggccctgtatcctgcagaggagagggaagcatcaggaagctcttgtggcctggtgagttctgtttcatcatggctggacactcggagctggatctcaacgcagctgtcctgtctgggacttccagggcatgatcatttccaagagtcaaaagccaatctctcatgcaccagtcaggactctgggttgccaacatcagacactgactctggcgtgcttggagagtgaaggaatctactgaacggatatcaggagctgacagaatcagtggtggggccagagaatcagtatcggaaaatatgcatgcaggaactgaaggaaactgggggagttggggggctggaatcactgccaaggtcgtgccacaggaagaggctgtttaggctctgttgctcccactactggactcagaccattgtaccctggatgccactaccactaggggtgggacgattttcagactgtcaccagattctttcacatcgtccctggcttcagattcacagcctcaggcaaaagcattgggttggccaagctcgggccacttgcccgtgcccatgctgtcaaggttcaggagaagagaggctcttgaaatttcactatggcagcttccattgaaatagggagagaatttggaatctgggcagccaaataacaaaaaacgaatatcctctgcatctgccaaacaggccaccacagcagcctctgcttggaaaggccatttgcaaagcaggagagtagaattcagtggagcatggattaactcaagctgtagtatgctcagcctggctccctgggaccagccttctgaaggggaccatgggtactgctatactcaccttcgtctagagaggcccctagtctccagcctgactcaaggaagctcctagacagcatagagatgctctgaactccaggccgtattttaggaaatttaggaagtaaccctttgtgagcactgggctgcattcagaagaactcagttctagtttcagattcatttataattcacagcatcacttagaagtttataattcctaccatttgtcccagcaatccattattgggtatagacccaaaggcaaataaatagttctaccataaagacacatgcacacgtatgttcattgcagcactattcacaatagcaaagacatgaaatcaacctaaatgcccatcaatagtagactggataaaaaaatgtggtacatatgcaccatggaatactatgcagccatgaaaaaacaagatcatgtcctttgcagggacatggatggagctgaaggccattatccttagcaaactaatgtgggaacagaaaaccaaataatgcatgttctcacttataaatgggagctaaatgatgagaactcatggacacgaagaagggaacaatggaggctggggcctactggagggtggaggatgggaggaggtagaggatcaggaaaaataatgagtactaggcctaatacctggatgacaaaataatctgtacaacaaaccctcatgacacgagtttacctatataacaaacctgcatatgtacccctgaacctaaaataaaagttaaaaaatcag

SEQ ID NO: 193310 - DNA, 1483 bp, Homo sapiens
  Payload ID: 18160
  Gene Name: transmembrane p24 trafficking protein 3
  ENST ID: ENST00000543455
  CDS Start-End: 92-532
atcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagggcttcagggtcttctgcctgtagctgccaaaggaagagagaatgagaaaagcccatctacttcttaaaagcccaggcccagtgggaatacgtatcacctgctcatgtcccatggatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagc

SEQ ID NO: 193311 - DNA, 2265 bp, Homo sapiens
  Payload ID: 18160
  Gene Name: transmembrane p24 trafficking protein 3
  ENST ID: ENST00000536821
  CDS Start-End: 95-562
tacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtagaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagggtcccagtgcttcaccaacaccaacgccaccactaagggttccagtgtgatcaccatctgggatctacctgttccaactgcttgtttacctcctgtgcatgctccacgggacatggctctttgcctgtagatcgccaggtacccacagctttactgccatggtgcacttcacttcctgccttgtccactctcacctgcaccagttattgcttacgtggtaatcagtatagtcattgatcttcagggaccatccagctacccgatttccaatgtggctgcctttgctatcttgttttggaaaatgtcttaaggctgttgaagattatatctatttgatcctttgtgcccttagatggagaaaagaaatgtattgagtagaagctctgaaagtttggaaggtccctcacaccatcctcaggttcagagtttcactagatgaagtcacagaactcagcaagccaatttacccatggttacagtttgttagagcagaagaatacatttgaaaatcaacaataagaaaaggtacaaaaggtaaagtctaggagagaccaggaatggagcttcccacttgtcgctccccagtgaagtcatacagactgcacttatctctccccgcaacgatgtgtgacaatatgcctagggtattgccaactagggaagttcacttgagtctcagtgtccagagattttattgaggaatcagtcacatagatatggctagccaccatacgactgactttgatctctagcccctccagagataaagctgatgttgtgttgtccaaggacctcaccataaatcttatggttagtacagactatctggcatggcccaaggtcctaggtttataaagacacttttgaaagccaggacattccaagggcttaaatgttaccttccagaaactgggggtaaagagccaaaactttctttgggttaatcctttactgcataagctctaagaccccaataattcatggccctatttctggggcatgattcagcccagagaagagatcggagaaacctacctcccatcatcaaagagctcctggatgttccatcaagcaaaactgtgggaggaaattcagtgttcctatggagatggtggtgtgacctgagctggctcagaggttctaaaagcttcttctcaaacattggcaaggtcacaggtacccaataaggtacatcttccctttccttcaacagtccaaaacctccagaactctctcgaggcagtgattaatactaaacaaaggacttgaaggataggagggattctgaacagggtagaaataaatagtagtgtgggatattcgtatagttttcttggaagaggtaatatttgagtaggatcttgaaaaatgagtagacgtgtaaatgccacaagtaaaggcaaagatatatacatcattgtcggaataggaaagagtgtggcacatctgggaatgatgaggggccttatgcagctgggggagtctattggtcagacatgaggctggaaatggtgcaagggctagatagggaagggcttcatatgcgatgccaagaggcacagactatgctgtgattccctggcagtatagctggtgggacaaagagaaatcaaactcaaaaagttcccctcttgtctaccatgtgtatactcaagtaggtgatgagattgtaggaagaaggtaggatataatagcagataattgggtagccatatagaaaaatcaaataaaatttgacctttaccttataaaa

SEQ ID NO: 193312 - DNA, 2203 bp, Homo sapiens
  Payload ID: 18161
  Gene Name: transmembrane p24 trafficking protein 4
  ENST ID: ENST00000289577
  CDS Start-End: 82-618
ctaactctcagggtcgctagggtggcgcgcaggcgcagagcgatgcgcaaatgtgcgcaggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctaaatcttagaactatttttggataaattatatattttccttcctagtagaagtgttactgcctgtaactagctcaaaataccaatgcagtttctgcattctgggttttgtttttccttttttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 193313 - DNA, 2322 bp, Homo sapiens
  Payload ID: 18161
  Gene Name: transmembrane p24 trafficking protein 4
  Uniprot ID: Q7Z7H5
  ENST ID: ENST00000457408
  CDS Start-End: 54-737
gcaggcgcagagcgatgcgcaaatgtgcgcaggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctaaatcttagaactatttttggataaattatatattttccttcctagtagaagtgttactgcctgtaactagctcaaaataccaatgcagtttctgcattctgggttttgtttttccttttttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaatagctgtgtttgagatgaaataagaggttgtgggtagaggggaggcacctaaaggaaaagaggaaaggtgcctgggctacctatgcagataacctggagtggacttcactgtggactcgtggtactaaggcttggcctggacaggcagtctagggggtatgggaatacacggtgtggttgttcaactatttgcaaaggtcaaccaaatagaccacatgttcgcaaagtatcatctgaggaaattaagtaccttcttagccctctcagtcataaatttgaacaaattttaatacacttccctcatgcccttctatataaaacttaataccattagttccccattcttgacattttatttcagtttttattatatatttatttgaaatatttattaaattatctgacctacagaactaaa

SEQ ID NO: 193314 - DNA, 1755 bp, Homo sapiens
  Payload ID: 18161
  Gene Name: transmembrane p24 trafficking protein 4
  Uniprot ID: Q7Z7H5
  ENST ID: ENST00000481238
  CDS Start-End: 26-586
gcaggcgcttaggggctgaggcgcgatggcaggtgtcggggctgggcctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaagggcaagtgcatatctccttgtaatttgagagggcagttgacctttatacccactatacctactcaagtttctgcttgggagatcagctctgcagagaatggaatgagaagtattggtttagataggttgtttgtttgttgtttttgagacggagtttcactcttgttgcccatgctggagtgcaatgccatgatcttggctcactgcaacctccgcctccccaggttcaagcgattctcctgcctcagcctcctgagtagctgggattacaggcatgcgccaccatgcctggctaattttgtacttttagtagagacgggggtttctccacgttggtcaggctggtctcgaactcccgacatcaagtgatccgcccgcctcagcctcccaaagtgctgggattacaggtgtgagctaccgcgccctgcctgttttgcttttttatcaaaacattttattgtggtaaaatataacaccaaatgtgtcattttaactgtctatatagttcagtggtattaagtgccttcataatgttgtgctaccaacaccatcatccagctccagaactttttcatcttctcaaactaaaaatctgtacttattttgttttgtttttgagatggagtctcgctctgttgcccaggctggagcgcagtggcgccatctcggctcactgcaccctccgcctcccaggttcaagcgattctcctgcctcagcctcccaagtagctgggattacaggcaagtgccaccatgcgtggctcatttttgtgtttttagtagagactgggtttcaccatgttggccaggctggtcttgaactcctggcctcaggcaatccactgccgcagcctcccaaagtgttgggattacaggcgtgagccactgcacccagcaaatctgtacttattataaacaataacttcccgtttccttttgtcctgacacccaccattctactttctgtctctatgatcctgactaccctatctcatataagtggaatcattcagtatttgtccttttgtgactggcttatttcactgagtataatgttctcacagttcatccatgttatagcatgtgtcagaatttcttaaggctaatattccattgtatgcatgtgccacatttcgctttcagtagtcatttttaagctctataaaataaaatgaagaaaggacagttcacaatcta

SEQ ID NO: 193315 - DNA, 750 bp, Homo sapiens
  Payload ID: 18162
  Gene Name: transmembrane p24 trafficking protein 5
  ENST ID: ENST00000370280
  CDS Start-End: 20-508
cgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggtcagtatggtcttctaataaaataaaaattattaacagccagaggccttactatggtaataagttactgaactaagcattttatctgcattatccaggaaaatctgtttctaatattttatttttgccataaatactttgacctcaagtatcagcttaattttattttatattaatatagcccttttatagttttcaaataacttatcttccaggaccctattataaaaatagcttcagatgtgcaaataagactgcat

SEQ ID NO: 193316 - DNA, 6104 bp, Homo sapiens
  Payload ID: 18162
  Gene Name: transmembrane p24 trafficking protein 5
  Uniprot ID: Q9Y3A6
  ENST ID: ENST00000370282
  CDS Start-End: 487-1176
gaaccgccgcgggagccgttgggacgcgcctacccggtcactgccccgccccggcgcagactgcgtgaggcgccgccgaaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccacatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgccagtcatttgtaaatgctgtctactcctgaaagccttccttcatctctatttagttaataatgtgctctctcctcctgttttgaaaccccatagctctctacacctcttattgtacatcactctactttgcattggagttctgtttctatatgtacttattcacctgttgcctaaacatgcactgttcctaaaaggtacagtttttgctcaaaatatatgaaaggaaagataatcagttcttaaagtttggtatgctaaataagcacccagggaacttacctgctccacctcaccccagaaattgattattcaggtctggaatatggctcaggattcttaattttcaaccaacacaatatagaatcctgtcagttatccttggatcatttgctaagtgatcttgcaaaatcaaaactcctttgagactatttcattttcagaaatattttaaaacttgttcagaaacatcttaaaacttgttagcatataggaaaagtacaatgcttggtgtaggtaggttattatttggtcatttccctcaaaccatccagacaagccactcttctaccacaagctggtagaaatccttaggcacctttctgcttctgcactgctatcactttcaggtgtctaaggcttctggaaggctgttgtcataacctggagccatacacctaatgtacgtctggggaaaggacaccaattaaagaatctagagctaggatgatgttacataagacagggcacaatggagatggactctggatccctgcatctgaaagaaaaaggcaagaaaatgcagggcagggaaaatcctgaaggtcttcactgaccatgaattaaaatcctaattgacagttttacaaacaaaaaccctcgttttagtacttgtgttgtttttgtttctgttttaacaagcttagatttattattgtgccttttatggaagatgaggaagaaataggaaagcagtaaaatgaacaatgagaatctgttacccaaactgatataaactccctcagaaagaaagatactactccctaatcctggaagtgttaagtggcaataatgatcaaatgttgtaaaggggattgttactacagctaatatgaaatgggaggctggactaaatctaacctttctacccttgatttcaattctaaaaggacacgtaataccattgcagaaagaaaagacagttccaaatgataaattttagagttgttttgctaggatgcaagagaaattggataagtggaccactcatacgttgctggtgagatatgaaatagtagagccactgtggaaaatattcttggcagtttcttataaaactaaacatacatttaacatataactggcatttgtactacttgacagttatccctgagaagttaaaacttaacattcacaaatgttacatagcaccttcatttataatagccaaaacccggaaacaacctggatgtccttcaaaaagagtgaatggtttagtatgtccacaccatggaatactaaatagtaatatgaaggaacaaactactgatacatgtaacaaattgcatggacctcaagggaattatgcttgggtggtttggggggacaatcctaaagttttacacactgtatgattctgtttttgtaacattcttaaataataaagctatagagatgggaaacaagattcgtggttgccaggtcttgggactgaagggaaggagaatgtggctataaagggagccttgtggtggaaaagttctgtagtttgattgtggtgattacataaatatacatgtgaaatgttagaagtatttatagctgaaacatattagtatgttggtatatacatatttctgactaattaatttcgccatgttgcccaggctggtctcgaactcctaagctcaagtgatgtgcccgcctcaacttcccaagtgctgagattacaggcgtgagccaccatgtccggcctgttttttcctatgcatgcataattacgatcaagtttaatttgtaattaggcacattaagagattaacaatagctaacaaaatggaacaattacaacaatatattgtaataaaagttatgcaaatgtg

SEQ ID NO: 193317 - DNA, 1296 bp, Homo sapiens
  Payload ID: 18162
  Gene Name: transmembrane p24 trafficking protein 5
  Uniprot ID: Q9Y3A6
  ENST ID: ENST00000479918
  CDS Start-End: 120-701
acctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaccctattataaaaatagcttcagatgtgcaaataagactgcatcttggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattac

SEQ ID NO: 193318 - DNA, 3847 bp, Homo sapiens
  Payload ID: 18162
  Gene Name: transmembrane p24 trafficking protein 5
  ENST ID: ENST00000370290
  CDS Start-End: 275-637
gtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacacgtgtataagaagtaaaaatgggccaggcactgcggttcacgcctataatcccagcactttccgaggccaagtgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccacatgtaaggatttttcatctgaagtacaataatgcacaatcagtgttgctcaaactgctttatacttataaacagccatcttaaataagcaacgtattgtgagtactgatatgtatataataaaaattatc

SEQ ID NO: 193319 - DNA, 938 bp, Homo sapiens
  Payload ID: 18163
  Gene Name: transmembrane p24 trafficking protein 6
  Uniprot ID: Q8WW62
  ENST ID: ENST00000288025
  CDS Start-End: 57-779
cttgatttccctgggctgcgagcagttcacctgcagaggaggctccagaaagcggcatgtcccctttgctctttggggctgggctggtcgttctgaatctagtgacgtctgccaggagccagaagacagaacctctaagtggctctggggaccagccactcttccgtggagctgatcgatatgactttgccatcatgatacctccaggaggcacggaatgcttttggcaatttgcccaccagactggatacttctatttcagttacgaggttcagcggacagtggggatgtcacatgaccggcatgttgctgccacggcacataacccacagggatttctcatagacacctcccagggtgttcggggccagattaacttctctacccaagagacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggacggcacacaaaaggtgcagaacaatatctttcacatgtggcgatactacaactttgcccggatgaggaaaatggctgactttttccttatccaatcaaactataactacgtgaactggtggtcgacagcccagagccttgttattattctttctgggatcctgcaactgtatttcttgaagcgtctcttcaatgttccaacaactacagatacaaagaagccaagatgctaagctaaggtgactatagcaccctggctgttttcttctggggcttagtcgaatcagctttgtaatgttatgggacaaaaatcaattatctcattaatgttttagtctgctgcacacatctaaaaaagcaaaatggcaataaaatcataacagtgaaaaagt

SEQ ID NO: 193320 - DNA, 3757 bp, Homo sapiens
  Payload ID: 18164
  Gene Name: transmembrane p24 trafficking protein 7
  Uniprot ID: Q9Y3B3
  ENST ID: ENST00000456936
  CDS Start-End: 382-1056
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttca

SEQ ID NO: 193321 - DNA, 572 bp, Homo sapiens
  Payload ID: 18164
  Gene Name: transmembrane p24 trafficking protein 7
  ENST ID: ENST00000508420
  CDS Start-End: 328-572
attaggaacttcatagctgcaagctaagggaatgctatccatcctgaaggattgcctattcaacaaaaggcaattggggtttgtcttattgctgcaggccttgcttctcagtcactgactgactgttgagagccaaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatgg

SEQ ID NO: 193322 - DNA, 1473 bp, Homo sapiens
  Payload ID: 18165
  Gene Name: transmembrane p24 trafficking protein 9
  Uniprot ID: Q9BVK6
  ENST ID: ENST00000332598
  CDS Start-End: 58-765
gcggcggcagggcgacgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaagggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 193323 - DNA, 7784 bp, Homo sapiens
  Payload ID: 18166
  Gene Name: transmembrane p24 trafficking protein family member 8
  Uniprot ID: Q6PL24
  ENST ID: ENST00000216468
  CDS Start-End: 57-1034
gctgtttccggagccactcgcggctggcagcggagagctccgtgcgcgggctgcagatgtctgacctgcaggcggctgaggggccgggctcctggagccccacagcccgcccagggtcggctggcggcgtcggggactgccagggagtggaggggagccaggcggccgcctcagagaatgaagatctagaaaacaaggatacctctttattggcttctgccaccgatccagaaccctgctcctcaccccacaggccacagatggtatctccagtgagtaaggatgccacggaagatctgcggaaagcaactggtcctttggaggctcaggccttggtgaaacaggatttgctgcctgcagaccaggcccaggtcctcaatgagatggctaagtatcaagttccacagaggtctggggacatcgttatgatccagtctgaacatacaggagctatagatgttctttcagctgatttggaatctgcagatcttctgggggaccacaggaaagtctccccacctctgatggctcctccatgcatctggacctttgccaaggtgaaggaattcaaaagcaagctgggcaaagagaagaacagccgtctggtggtgaagcgtggtgaggtggtgaccatccgggtacctactcatccagaggggaagcgtgtctgctgggagtttgcgaccgatgactatgacattggctttggagtttattttgactggacccctgtaactagcactgacataactgtgcaggtcagtgattccagtgacgatgaggatgaagaagaggaagaggaggaagagattgaagaacccgttccagctggagatgtggagagaggctccaggagctccttgcggggtcgctatggggaggtcatgcctgtgtaccggcgggacagccaccgagacgtgcaggctggcagccatgactaccctggtgagggcatctacctgctcaagttcgacaactcctactccctgctgcgcaacaagactctctacttccacatctactacaccagctgaaggactgctgggacaggggcaggctgtatttgctggctgaagcaggctgccagctggtgcctcttgtttgggataggcaagagccaaaggttcatggggggctgctgagcctcacaccctgtctggcatgcctgactgttggcccacgtagctttttccccttcttggcttctgcaggtggtggtgtagtgcccctgttctgtagtccctgactcatacccttcttgcttcagactccagcaaattccctcttgaaggcacctatggggcacaagcctaaaaggaagcagggcgatgttttttaaaaatagattcatcttggcacaggtttatcattcagattgctgccctctcctctcccacagcccttattgccagtgcatttagtggcacccactctcttcagttgttgaggtgccagaagagggaaaagcacattgcccatgaaggagccccatcttttggttggagaaagctctatccagcctgtcaccactgccatattcctgcctgctggttattcttggtctctgcatagctgggagaccacactgcctttggagggctattactattcctgatggtagacaccccctcctttctctttcctaagtctatgtttttgccattacagcaagaacattcatgcaatctcaagtgatgatcaatgtaacctaagatcttgtgggaagaaaaactgcccccattatttcctattccaagagctggtttcccttactatgggcactggcagtcaaagtggagagagtggaaattaggtactgaattgatgtcagaacccacatatttgaaagtcgtgttacttttttttttttttttggtataatcaaagaaggaatggtatcatctgacagagaagatgaaaaacaaaaaacactccagagtccccaccgcttttttttgtctttagagtaggagtgctgtttagaaatgttgctttggaatcaaatgcagtgaaacccaatcaggtttccaaagtttctgcatttagctttcttgcattgagggcttaaagcttttggtgttcaaagtcccttagtttaggtgataatgaagcttcactattgctgctgattgtatttgttctttacctgaccaaagcttgcatttccctggtgacagcatttcctactgtgtcacccctgaggctcaggagtgccacagagtgcaggtagtgctgcagccagtggtcaccagagcaccagctgctgggcccccaggcggaggaggagacggaggtgagatgggacctcagcagtctctgtgtttgtacctccctgtctcttactcctcgtgttatgtctgttactgcctacgaattctgaagaataattagatttatttattactgtatttatttttttagcacatttcattttgcctttgaaacagtttccatctgtttctcagaaggcttcccatctgttctgagccactgaagccccctcttttatggagttaaagatgatatttttaggagaatttgggaagcgatgatgttttatttctgtaggtcagtcctgtgacggctttgcgaggagtatggcccttcagagatggatgatgccaccttactccatgtttggggtacagtccagcactccccatgaaaaattctaagttgtgagggaatctgcccatttgctggagattgagtgcagaggaattccctaaccaatcagagatatcccgtgattccaggatttcagagtcctttgtctcctctgaggtgtcaccttctttgtgatgtttcctttgactcattgttagattcctcacaccaagggtctatccctacagtagcataactcaaggaacgggactcttcccagtgggtccctagtagcatctacatcacatcaaagggcaatatatcctgcacctgctcttcccctcggagcaaagccccaagtgggataggatgttggggactgccagagcattcccattctctgagcagcatcatacctccattattttatatttgcaaatgtgttttgtagaggattacactggccaacatttatatacctttaaagaaattattttagtgactgtctgttgaggcagtgaagagctgatttgctgtgtgtcatcccattggatagctgagtgaccgctcttgcatcattgaagttgaatcatgccttagctaactgaatataatctttgtaaaataattttctactgagctgttttctagtcagctaaagccttgcttatttttcctgtttattattaacttctgcctttctctcaaattgaaacagtcaggccatacacagcaagctcccaaggataacacttgttattatttattttcaccatgagattctctgcttattttctttggaatcctagttctgttgcatcagggaagcctaagggacttgttcccctcacctctgtgtgcctcttagggtctggtcacttttgaagtcctgggcatggttacatttcattcatactggtttttcaccaactgtcagggtttctgtgttccattagcacaaaatagctaaaagaagatattttcactgtctaattcactattttcatgttacatttctgaaataattgaactttaggggcaagatactacttactgaagcacaggtaattactgagaacccacagcccagcaaattctaagagacagtcatttcctcagcccctcccagtccaaatttatagacccaaacaatgaaatgaaaaccgtttgctttgatcctcaccctgttctctagagcacaaacaaatagtaacaaacaattgaaagaaagtgcttcatagtaggagagagattggaattctctatagtgactgagttcttaaatttctttagttttagttttgccactttgttgagagatgggccttttagaaaggaagacatatttaaagtattgatttcttttcccccagtgttttattgtgaaaaaatttcagcaaacagcttaaaagaaatataaatatattgtaaaccaaaaagtatctgagacaggtctcaatacatttagaggtttattttgccaaggttcagagcccatgatggggcctcaggaggttcttagaacatgtgcccgaggtagtcgggttacagttttatacatttgagggagacagaaggtccaggcaaagccataaatcaatacatgtaaggtatacactggtttggcctggaaaggcaggacatcttgaagatgggggtttccaggtcagaggtagatcaaagagttcctgactggcagttggttgagagagttaaactttacctgaaaagatgaagtcagcttaagttaaagtaagggaggcttggcttaagtcatgtagatgaagcctccaggtagcaggcttcagagagaacagatgatgaatttttctttttaggccttaaaaggtgtcagactctccagaaaagacctaataagagaaggagattctctacagaatgcagtttcccccacaagagacagctttgtagggccatttcaaaatacgtcaaataaatatattggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaggcaccctgtcttcccatcatggactagtttttcaggttcctttgagatcccctgggccaagacaggggtccattcagccggttgggggatttagaatttatttttggtttgctgtatatatatgtatacacacactccccgcataaatgtaaaaattttaaactaccaattcctaggcaaagatgattctaacattctgttccttttgacaagtgtccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaaattgtttcttggtctccatctttcaagaaaatacatctgtgctgtattttccccttccctcaggccatgatctctgctgttttccttactaactggcatgtcagtacaagagtgattgtgaagctgctccggaagggctttatgctaacctctgttgcttgatgacatgtcctcaggactctgatattaaaactcaatccttagataacaggtagctttatcatggaagtaggtagcaatttggaattagaccattcttagttatttttttcttaatgaattgatacatgcactttaaaaaatatttttgttattttgggaagaaaaactcagacttttaaaaaagtgtatattgtcccattataatatgtatatggaagagtgaaatctgaacgctgtcttatattaagcagtagaattaggtattatcataaaaagtcttaatctgtagggaatatgagtttatgtttatgagtcctgctcagtccctctttgagagaattagttgaaacccagactctaaagtctgcttttatatttgtttgttaagaccacttatctgcagaaggttgccttttaaccccagtggttctaaggtgtggaattgagtgaccctaatatttacataagagacttgttttagtggagcataagggaggggcataagttacaccgttttgtgctgcttgagaactgtcttttaaaattgatcacaacgagggaaaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccagagttaatgtcatgactcttcaaagatatgatgaaaagttgccctagaaatctagagatgcatgtttatttaattccatagtttaaaaaaaaatttaagcaggtagttgtggcttatctgggggcaaaataatatatgtgaaattgcttccagaggacaaagtatattttctaaagtcctgaaataggatcatgaacccttctgaagttttggtttgaaatattatagtatatgatattaccaaagagcccttaattcagagtttaaggggctctcttcctgaactctcttcatcactcagggttgaatgtgtaatgttccttgctattgattgttattgttgattcttaggatcaggccaagaatcatctggaaaacattatcttaattccgtctctcatatcctaaacagtacattttactaagaaattccatatgaaaaactccactcatgtctcctgagattatcctgtaagtgaagtagctttcatttaaccaagctaaattatttccatttagccatgttaaagagaagccaagtctagagaaagcaatcctgtaacccatgaatctggtgtacccattttcccttaacgtaacgggaagtgttttgaaattcccagaagagagctgttttgtaatcaaagtgatggattataagaaagccagactttggaaaaggataattggaataaagggaggtgcttgaagattttccaaactactttatgtcatttagcttctattttctgaagggctttctttggtgccatgtactcagatcagtcagttgactgaaagatgatcatgttttcttcgtaaagatttaagcaattggcaactacaaagacattattttcttactgttctatatcatgtactgttgctgacattacaaaaagggtctggaagggaaaccgtgtcactgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaactttttcactatgcacctggtaa

SEQ ID NO: 193324 - DNA, 2542 bp, Homo sapiens
  Payload ID: 18167
  Gene Name: transmembrane phosphatase with tensin homology
  Uniprot ID: P56180
  ENST ID: ENST00000622113
  CDS Start-End: 353-1954
cgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagctt

SEQ ID NO: 193325 - DNA, 2036 bp, Homo sapiens
  Payload ID: 18167
  Gene Name: transmembrane phosphatase with tensin homology
  Uniprot ID: P56180
  ENST ID: ENST00000427445
  CDS Start-End: 331-1872
gggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaa

SEQ ID NO: 193326 - DNA, 1874 bp, Homo sapiens
  Payload ID: 18167
  Gene Name: transmembrane phosphatase with tensin homology
  Uniprot ID: P56180
  ENST ID: ENST00000612746
  CDS Start-End: 469-1710
gggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggcagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaa

SEQ ID NO: 193327 - DNA, 755 bp, Homo sapiens
  Payload ID: 18167
  Gene Name: transmembrane phosphatase with tensin homology
  ENST ID: ENST00000612957
  CDS Start-End: 334-755
caagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaa

SEQ ID NO: 193328 - DNA, 2150 bp, Homo sapiens
  Payload ID: 18167
  Gene Name: transmembrane phosphatase with tensin homology
  Uniprot ID: P56180
  ENST ID: ENST00000618007
  CDS Start-End: 331-1986
gggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgcccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtaaaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaa

SEQ ID NO: 193329 - DNA, 1562 bp, Homo sapiens
  Payload ID: 18168
  Gene Name: transmembrane phosphoinositide 3-phosphatase and tensin homolog 2
  Uniprot ID: Q6XPS3
  ENST ID: ENST00000255310
  CDS Start-End: 46-1383
agtccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatag

SEQ ID NO: 193330 - DNA, 1677 bp, Homo sapiens
  Payload ID: 18168
  Gene Name: transmembrane phosphoinositide 3-phosphatase and tensin homolog 2
  Uniprot ID: Q6XPS3
  ENST ID: ENST00000382978
  CDS Start-End: 44-1492
tccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatagataaaa

SEQ ID NO: 193331 - DNA, 1558 bp, Homo sapiens
  Payload ID: 18168
  Gene Name: transmembrane phosphoinositide 3-phosphatase and tensin homolog 2
  Uniprot ID: Q6XPS3
  ENST ID: ENST00000390680
  CDS Start-End: 211-1548
atgatcgaagcagtacaaatcaggggagaacgtgcccaagacctggagaactgataataaattgtggtttatccttgcaatggaacactatatggaagtgaaaatgattgaaatagagctatacacatcatcacagacaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatga

SEQ ID NO: 193332 - DNA, 1652 bp, Homo sapiens
  Payload ID: 18168
  Gene Name: transmembrane phosphoinositide 3-phosphatase and tensin homolog 2
  Uniprot ID: Q6XPS3
  ENST ID: ENST00000400103
  CDS Start-End: 238-1473
agaccaaattggataaaagaggacgaagtcatgaaagggatgcttcttcctcttagtatatttgtcactctaagttggtggtatccaatcccttaggaacgaacctctgaggttttccatttatgagactctcctactactagagtgggccaaagggagagagaatcctatttggagcaatgaggaggtaacagtccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgaatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatag

SEQ ID NO: 193333 - DNA, 1793 bp, Homo sapiens
  Payload ID: 18168
  Gene Name: transmembrane phosphoinositide 3-phosphatase and tensin homolog 2
  Uniprot ID: Q6XPS3
  ENST ID: ENST00000400230
  CDS Start-End: 46-1614
agtccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaagggagacagcagtatttttctgacttatttaacattttagatactgccattattgtgattcctctgctggttgatgtcatttacattttttttgacattaagttgcttaggaatattcccagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatag

SEQ ID NO: 193334 - DNA, 1220 bp, Homo sapiens
  Payload ID: 18168
  Gene Name: transmembrane phosphoinositide 3-phosphatase and tensin homolog 2
  ENST ID: ENST00000462409
  CDS Start-End: 1-1014
atgaatgaaagtccacagacaaacgaatttaaaggaacaaccgaggaggcacctgcgaaagaaagcccacacacaagtgaatttaaaggagcagccctggtgtcacctatcagtaaaagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgagagaagagggcagcacacagggccaactggaagggggagccatccaggagacctgtgctcgactgatgggtgggagcaatagcgagagagagggagggacctgagagtggaagcctttattgggataatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatga

SEQ ID NO: 193335 - DNA, 3054 bp, Homo sapiens
  Payload ID: 18169
  Gene Name: transmembrane protease, serine 11A
  ENST ID: ENST00000334830
  CDS Start-End: 748-2013
ctgagggagaaggaaagggaccaagagtaggacattgtcaaacatggttttagtctcattttttacaaagaacatgtattaatatgttgtttgtctaattgaaaatgtttatttcttctctttttttcattctgataaatgtctgtcaatgttttatcacattaagtcatttggggaaacatatagttttatattaatttatttgcctgtactctcagaagtgggtatttaaaaaaactattatgtattagtaaattcactatgcttctgtaagatacctgctgttcaacatgaatttatggaatatttcttgagttatatttttattatgtatttagattttaagatctgtttgtttttatctagagcttttatgtgacagtttctttaaaatacttatatacctaccataatcttctttaaattcttaattctagtacattcctaaggtatttctcattctaatctttgtaaccagtttctcctcctttaacaaaattagtccatactaaaaaaatattgctttcttgttgggactatcctgtctctggctttcttcaaggccttctatgggttgaaacttctctgttcagacttgtcaaactagtttcatttcaactacttgtaatttgtttccttatttctttgagccgtagacttctaatacatctagagatgtcatatagttgattagaaagttgagttcagtgggtgcagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtgagtcaggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgtatgcaggtcatatatgcatgagaattcaactatttagtgggtgtagtacaacaaagtgatattaaattactggatctagtaacatgaaacacacaacgtaagttatttagaatcactttaatcaaccaataatccttagccaatttataagggacttttatttgtaaagtaatggatctggcttgaaaaatacggtagagatacttagctctttaaatcacgaatgttgaagtaccagtgagactcaatacatatttttgaagatagtccatgggatttttagaatgtcgttgtcaagggtctccttttaactgagaaactttttgaactcacaaagtgttcaagaaacccttgtataattccctacatttctctcgagctcacaaatacttttttttctttttccttattcaatcagattttccaaagtacctttccaccataagaaatgaattttctacttctacacccatttgagagacaccaataaaagaaagtcatatgtaggaaacaaagtctgatagtaaaacaagccagagatcttctaactttttttagttataaaacctctaatttttggtgacttttctacacacacacacacatacagtcacatagatattcttatcctacagatataatcagaaaaatcccgattaatgaattatatatagatagatagagtgattagttaatcaaaactatatatttgttaaaaatttgggagaaggtgatggtaatttcattagtcccaaaacaccggcataagaaatttgacatttcacagatgcacttacatattttgaccacaagggggaaattttgtgcattattattgtagggttaaatgcctgaaaaaaataagcatttactaataccttgaaaaatcaaagaacattatgttcctccgtagcaagaaaaattttatgccctcgcattgctacagccaaatagcttataaggcttatggcaatgtcccaactattgcaatcataaaaccctagttttag

SEQ ID NO: 193336 - DNA, 1350 bp, Homo sapiens
  Payload ID: 18169
  Gene Name: transmembrane protease, serine 11A
  ENST ID: ENST00000396188
  CDS Start-End: 81-1253
atctagagatgtcatatagttgattagaaagttgagttcagtgggtgcagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagtt

SEQ ID NO: 193337 - DNA, 3247 bp, Homo sapiens
  Payload ID: 18169
  Gene Name: transmembrane protease, serine 11A
  Uniprot ID: Q6ZMR5
  ENST ID: ENST00000508048
  CDS Start-End: 34-1290
cagacctgcaagatcatattcttcctcctgtacatgatgtatcggacagtgggatttggcacccgaagcagaaatctgaagccatggatgattgccgttctcattgtgttgtccctgacagtggtggcagtgaccataggtctcctggttcacttcctagtatttgaccaaaaaaaggagtactatcatggctcctttaaaattttagatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatgcaatgagctcatcaacaggggagttaactgtccaagcaagttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgtatgcaggtcatatatgcatgagaattcaactatttagtgggtgtagtacaacaaagtgatattaaattactggatctagtaacatgaaacacacaacgtaagttatttagaatcactttaatcaaccaataatccttagccaatttataagggacttttatttgtaaagtaatggatctggcttgaaaaatacggtagagatacttagctctttaaatcacgaatgttgaagtaccagtgagactcaatacatatttttgaagatagtccatgggatttttagaatgtcgttgtcaagggtctccttttaactgagaaactttttgaactcacaaagtgttcaagaaacccttgtataattccctacatttctctcgagctcacaaatacttttttttctttttccttattcaatcagattttccaaagtacctttccaccataagaaatgaattttctacttctacacccatttgagagacaccaataaaagaaagtcatatgtaggaaacaaagtctgatagtaaaacaagccagagatcttctaactttttttagttataaaacctctaatttttggtgacttttctacacacacacacacatacagtcacatagatattcttatcctacagatataatcagaaaaatcccgattaatgaattatatatagatagatagagtgattagttaatcaaaactatatatttgttaaaaatttgggagaaggtgatggtaatttcattagtcccaaaacaccggcataagaaatttgacatttcacagatgcacttacatattttgaccacaagggggaaattttgtgcattattattgtagggttaaatgcctgaaaaaaataagcatttactaataccttgaaaaatcaaagaacattatgttcctccgtagcaagaaaaattttatgccctcgcattgctacagccaaatagcttataaggcttatggcaatgtcccaactattgcaatcataaaaccctagttttagaaaaatttgaaaataaatataaaatttgagcacctactgcatataacacatggggctataacatataacatatagtatgttttctcttttggaccactttgttatatgtggtccacaagagaaaacatactccatcagcaacgtgtctcctgaagtcattaggagagtaaggctcatgtatttcgtaatacaattaaattaaggctttatggaagcaattattctgcttggcaatgcctgtgaaatattatggtctgcaggctggggagtcatttactcatttagcccaaatataagacaaatcattggaacgatgaacttgctttataataatttccctcacatgctattgagaaggcatgaaaataatcctaaaatatctaaaagagatatgcagttcactcataaaacacttgattcataatttagactcatagaattttaaagctgagaagagattgcatgtcacataggccaatatacttatgttatgtttaagaatatgagtatattcttaactatttttattgaattcttaactatttttattgaatcatcagatctgtaaaattttaagtgagagctattgaacctgtattaagatagaaaactcttaagataagaattttaaatgacgagattcatttaggcagctggctgccaattctctgaattcacttcaagacaaagtttcttcttcatatataaatatacataggcatataaattattctatattatggtggtaaaacttaatgctgactttggatgttcagattcaggaaatgatcttagaattatgaactttgtatttttaaactatttggtgcagcatttcattttgggtcacatgtaagcagatattgatatgtcatttttaatctaataaagttggtgatcagagcattctacaaac

SEQ ID NO: 193338 - DNA, 1190 bp, Homo sapiens
  Payload ID: 18169
  Gene Name: transmembrane protease, serine 11A
  ENST ID: ENST00000513536
  CDS Start-End: 1-1158
ggatttggcacccgaagcagaaatctgaagccatggatgattgccgttctcattgtgttgtccctgacagtggtggcagtgaccataggtctcctggttcacttcctagtatttgatccacaaatcaataacaatttcggacaaagcaacacatatcaacttaaggacttacgagagacgaccgaaaatttggtggatgagatatttatagattcagcctggaagaaaaattatatcaagaaccaagtagtcagactgactccagaggaagatggtgtgaaagtagatgtcattatggtgttccagttcccctctactgaacaaagggcagtaagagagaagaaaatccaaagcatcttaaatcagaagataaggaatttaagagccttgccaataaatgcctcatcagttcaagttaatggttgtggtaaacgagttgttccattaaacgtcaacagaatagcatctggagtcattgcacccaaggcggcctggccttggcaagcttcccttcagtatgataacatccatcagtgtggggccaccttgattagtaacacatggcttgtcactgcagcacactgcttccagaagtataaaaatccacatcaatggactgttagttttggaacaaaaatcaaccctcccttaatgaaaagaaatgtcagaagatttattatccatgagaagtaccgctctgcagcaagagagtacgacattgctgttgtgcaggtctcttccagagtcaccttttcggatgacatacgccagatttgtttgccagaagcctctgcatccttccaaccaaatttgactgtccacatcacaggatttggagcactttactatggtggggaatcccaaaatgatctccgagaagccagagtgaaaatcataagtgatgatgtctgcaagcaaccacaggtgtatggcaatgatataaaacctggaatgttctgtgccggatatatggaaggaatttatgatgcctgcaggggtgattctgggggacctttagtcacaagggatctgaaagatacgtggtatctcattggaattgtaagctggggagataactgtggtcaaaaggacaagcctggagtctacacacaagtgacttattaccgaaactggattgcttcaaaaacaggcatctaattcacgataaaagttaaacaaagaaagctgta

SEQ ID NO: 193339 - DNA, 2671 bp, Homo sapiens
  Payload ID: 18170
  Gene Name: transmembrane protease, serine 11B
  Uniprot ID: Q86T26
  ENST ID: ENST00000332644
  CDS Start-End: 163-1413
aaaaaccaagctccaacactggatgtagcacataagtcaaaagctgcgtcagaaggttctaacttttgtcatcactattaccagcattgtcatcgttatcgttatcttcgtcatcatcattaccaccgttatacctgatactgccataacaatcagaacattatgtacaggcacggcatatcttcccaaagatcttggccactatggactacgatctttatttttcttggagtggcggcaatcttgggagtaaccattggtcttcttgttcattttctggcagttgagaagacttactattatcaaggtgattttcatatttctggagtcacatacaatgataattgtgaaaacgcagcttcacaagccagcacaaatctaagcaaagatattgagactaagatgttaaatgcatttcaaaattccagtatatataaggaatatgtcaaatctgaggtcatcaaacttctgcctaatgccaatggttcaaatgtgcagttacagctgaaattcaagtttcctccagcagaaggagttagcatgaggactaaaatcaaggctaaattacatcagatgttgaaaaacaacatggcatcctggaatgcagttcctgcttccattaaactcatggaaatcagcaaggctgcttctgaaatgcttaccaacaactgttgtgggagacaagtagccaacagtatcataactggcaacaaaattgtgaatggaaaaagctccctggagggggcatggccatggcaggccagcatgcaatggaaaggccgtcactactgtggagcctctctgatcagcagcaggtggctattatctgcagctcactgctttgctaagaaaaataattcaaaagattggactgtcaactttggaattgtagtaaataaaccatatatgacacggaaagtccaaaacattatttttcatgaaaattatagcagtcctgggcttcatgatgatattgcccttgtgcagcttgctgaagaagtttcttttacagagtacattcgtaagatttgtcttcctgaagccaaaatgaagctctcagaaaatgacaatgttgtagttacaggttggggaacactttatatgaatggttcatttccagtgatacttcaagaagactttttgaagattattgacaacaaaatttgcaatgcctcatatgcatactctggctttgtgactgatacaatgttatgtgctggatttatgtcaggagaagctgatgcatgtcagaatgattctggtggaccactagcttaccctgattccagaaatatctggcatcttgttggaatagtaagctggggtgatggatgtggtaaaaagaataagccaggtgtctatactcgagtgacttcttatcgcaattggattacatccaagactggactctgaaaaaaaaggaattatacaaaggaacataaagaccactgtaggctatccttatctgtggctttgggatctttttattttgattgttggtaaactaatcattttattatatataaaaatataaatgtctttattaatattttattatatctaaaacactgtccatgcatttattaatcttttaaattaatgtaagagataggaagaggccaggtgtagtggctcatgcctgtaatcctagcactttgagaggccgagataggcggattgcttgagcccaggagtttgagggcagcctgggaaacatggctaaatccgtgttcaaaaaatacaaaaattagctaggcatggtggcgtgcacctatagtcccagctattcaggaggctgaggtgggaggattgcttgagcccagcaggttgaggctgtggtgatttgtgattgcgccaccactgcactccagcctgggcaacagagtgagaccctgtctcaaaaaaaaaaaaaaaaaaaggagagaagaaaataaagaaggctaatatataatttttcttaatagctgagttgtgattcattttaccattatattcagaattgaccttaatttgttttccagaatcaaaagaaaataaaatataaattttgaaactatgagaacatatataggggatttatcaaatgagttactttttattatatcaattataatttcattttattaactggaataagtgcgaaagtgtacattactttttaacttatatgtgaaatgattcatgtacctcacaaaatcatgcaatcttgcagtgaagaaggagtatcagagctccagctacactgagtctttcaatttacagatcaagaaactgaagaccagagaagagaaatgatttggttaaagtcactctccatcatctgtgataagttgacaaatttatccttacacaaatttgtcctcattgagttgacatccaaaatttgtcaggaattaaagaatgacttttgagtggcaattatttatataacattttccattgtcttcatattcaccttttgtcatttgtttgctttctcttgcagcaaaaataatatgaggtcatcaagggcagagaactgtgtggcatctccttatagtaaaagtgcaatcatatggatggctaactttgtaatctctacaaataatttaccttatgtaattttccaaatgtaaaagtcaccaaaaacttaaaggcattaaaataaactaaaaaagtactcatttcttca

SEQ ID NO: 193340 - DNA, 2817 bp, Homo sapiens
  Payload ID: 18171
  Gene Name: transmembrane protease, serine 11D
  Uniprot ID: O60235
  ENST ID: ENST00000283916
  CDS Start-End: 100-1356
actatagatcacacgtaatacatgagagtcattcatttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaataatatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaacgaattgaaagtttaaagagggggaagagttggtttgcaaaggaaaagtttaaatagcttaatatcaatagaatgatcctgaagacagaaaaaactttgtcactcttcctctctcattttctttctctctctctccccttctcatacacatgcctcccccaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattctttttaaaataa

SEQ ID NO: 193341 - DNA, 194 bp, Homo sapiens
  Payload ID: 18171
  Gene Name: transmembrane protease, serine 11D
  ENST ID: ENST00000514868
  CDS Start-End: 1-194
caatgaaaagcagaattgagtctgttttacgacaaatgctgaataactctggaaacctggaaataaacccttcaactgagataacatcacttactgaccaggctgcagcaaattggcttattaatggccacacagttccagagctaaggcaaggacaggtcagaataataagtaatgatgtatgtaatgcacca

SEQ ID NO: 193342 - DNA, 2136 bp, Homo sapiens
  Payload ID: 18172
  Gene Name: transmembrane protease, serine 11E
  Uniprot ID: Q9UL52
  ENST ID: ENST00000305363
  CDS Start-End: 65-1336
agctggattcacacacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcaccca

SEQ ID NO: 193343 - DNA, 794 bp, Homo sapiens
  Payload ID: 18172
  Gene Name: transmembrane protease, serine 11E
  ENST ID: ENST00000510647
  CDS Start-End: 1-376
gccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggt

SEQ ID NO: 193344 - DNA, 2136 bp, Homo sapiens
  Payload ID: 18172
  Gene Name: transmembrane protease, serine 11E
  ENST ID: ENST00000621758
  CDS Start-End: 65-1336
agctggattcacacacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcaccca

SEQ ID NO: 193345 - DNA, 794 bp, Homo sapiens; identical to SEQ ID NO: 193343
  Payload ID: 18172
  Gene Name: transmembrane protease, serine 11E
  ENST ID: ENST00000625246
  CDS Start-End: 1-376

SEQ ID NO: 193346 - DNA, 2088 bp, Homo sapiens
  Payload ID: 18173
  Gene Name: transmembrane protease, serine 11F
  Uniprot ID: Q6ZWK6
  ENST ID: ENST00000356291
  CDS Start-End: 61-1377
cctaacctgctgatacagatcagatggtgactgaatagaagctgccccagtcctgggttcatgatgtacgcacctgttgaattttcagaagctgaattctcacgagctgaatatcaaagaaagcagcaattttgggactcagtacggctagctcttttcacattagcaattgtagcaatcataggaattgcaattggtattgttactcattttgttgttgaggatgataagtctttctattaccttgcctcttttaaagtcacaaatatcaaatataaagaaaattatggcataagatcttcaagagagtttatagaaaggagtcatcagattgaaagaatgatgtctaggatatttcgacattcttctgtaggcggtcgatttatcaaatctcatgttatcaaattaagtccagatgaacaaggtgtggatattcttatagtgctcatatttcgatacccatctactgatagtgctgaacaaatcaagaaaaaaattgaaaaggctttatatcaaagtttgaagaccaaacaattgtctttgaccataaacaaaccatcatttagactcacacctattgacagcaaaaagatgaggaatcttctcaacagtcgctgtggaataaggatgacatcttcaaacatgccattaccagcatcctcttctactcaaagaattgtccaaggaagggaaacagctatggaaggggaatggccatggcaggccagcctccagctcatagggtcaggccatcagtgtggagccagcctcatcagtaacacatggctgctcacagcagctcactgcttttggaaaaataaagacccaactcaatggattgctacttttggtgcaactataacaccacccgcagtgaaacgaaatgtgaggaaaattattcttcatgagaattaccatagagaaacaaatgaaaatgacattgctttggttcagctctctactggagttgagttttcaaatatagtccagagagtttgcctcccagactcatctataaagttgccacctaaaacaagtgtgttcgtcacaggatttggatccattgtagatgatggacctatacaaaatacacttcggcaagccagagtggaaaccataagcactgatgtgtgtaacagaaaggatgtgtatgatggcctgataactccaggaatgttatgtgctggattcatggaaggaaaaatagatgcatgtaagggagattctggtggacctctggtttatgataatcatgacatctggtacattgtaggtatagtaagttggggacaatcatgtgcacttcccaaaaaacctggagtctacaccagagtaactaagtatcgagattggattgcctcaaagactggtatgtagtgtggattgcccatgagttatacacatggcacacagagctgatactcctgcgtattttgtattgtttaaattcatttactttggattagtgcttttgctagatgtcaagaagcccttcagacccagacaaatctaatatcctgaggtggcctttacatacgtaggaccaaaccctctctaccatgagggaagaagacacagcaaatgacagacagcacctattccttactcacaagggaaactgcttgtgatacttcctaataagataaataagtggtttccctcaattgaagacaggaacatcattttccacaggatatgaagagctgccagtaatgccaaaatcttacctcatataatacctggagcatgtgagattcttctagtgaaaaagaacagtcttccctgaagactcagggcttcaacattctagaactgataagtggaccttcagtgtgcaagaatggagaagcatgggatttgcattatgacttgaactgggcttatatctaataatacagagcactatctctaacctcaacagttgacattttaaaagtttttaaatgtatctgaacttgctgttaacacagtgttataactcaagcactagcttcaggaagcatgttgtgttgttaagaagcttttctgatttattctttaacagcatcttgccatctatatgttagtagcagttggcccagaaaggac

SEQ ID NO: 193347 - DNA, 2175 bp, Homo sapiens
  Payload ID: 18174
  Gene Name: transmembrane protease, serine 13
  Uniprot ID: Q9BYE2
  ENST ID: ENST00000430170
  CDS Start-End: 89-1780
ttaccctacatgcctgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtttttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcactactatcataaaagagtataaagtaataaaataataaaaagtta

SEQ ID NO: 193348 - DNA, 2361 bp, Homo sapiens
  Payload ID: 18174
  Gene Name: transmembrane protease, serine 13
  ENST ID: ENST00000445164
  CDS Start-End: 75-1835
tgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggaggtaagatccctgcagcaggacactgcacccagcaggctgggaacttcctcaggtggggaccctggaggagcacccaggttgtaggcagaggtcccctcagcgtccccatattcggggggtgttctggacagggtcaaatgtgatgcctggggtcaatcccagctgtctgtgtttctttccctgcttttcttccctcagaacagagctcagcgggttgaaaaagggtggacctacaggccaggcaggcagttgctgggcagatgttctcccagaagtatttttttgtgtaaggttgcaatggactttgaaaacgtttcagtttctgcagaggattttgtgatagtttttgttatcaagcatttatgcatgggaatccgctcttcatggcctttcccagctctgtttgttttagtctttttgattttctttttgttgttgttgttgtctttttttaaaaacacaagtgactccattttaactctgacaactttcacagctgtcaccagaatgctccctgagaactaccattctttccctttcccacttaaaatatttcatcagaacctcactactatcataaaagagtataaagtaataaaataataaaaag

SEQ ID NO: 193349 - DNA, 1950 bp, Homo sapiens
  Payload ID: 18174
  Gene Name: transmembrane protease, serine 13
  ENST ID: ENST00000524993
  CDS Start-End: 59-1762
aagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcggactcccacctccactgtctgctgcctctgtgtgtgtgtgtgtgtgtgtgtgtgtgtgtgcatatgtgtgcattgccactct

SEQ ID NO: 193350 - DNA, 3269 bp, Homo sapiens
  Payload ID: 18174
  Gene Name: transmembrane protease, serine 13
  Uniprot ID: Q9BYE2
  ENST ID: ENST00000528626
  CDS Start-End: 75-1673
tgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccagtccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcggactcccacctccactgtctgctgcctctgtgtgtgtgtgtgtgtgtgtgtgtgtgtgtgcatatgtgtgcattgccactctcccaagtttttcagaaaccagcagagctgtcaactcttctcaaaatcccaggctggaaattacctggagacaagagttgagtaccgtggatgttcctacaggagtgtccatagatggatggaggaggtggagcccagagcccaaggaagagctgggaattcttgcttctctgaccctcacttacagactagcccagtgtgggcagatgccagcggcccaggtggcgccattgctgtcctgggatggatcgtgggttttggtggatgcagcttcccagggcctggaccgtcttcggtgaaaagctgctcccgttggctttatgagcatcaagtcctcacccagaccccctgctggtgccgtggatgtcaccagtcggactgtgctgtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgacagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccagtagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacactggggaatgttagcaagactgggaaggaggccacattcctgtctgcagcagccgccagcgatggtcttcagcaataaaagttgtgtgacctga

SEQ ID NO: 193351 - DNA, 578 bp, Homo sapiens
  Payload ID: 18174
  Gene Name: transmembrane protease, serine 13
  ENST ID: ENST00000528135
  CDS Start-End: 124-246
tttggtgggggctggcccttggccctccaactcctttaccctacatgcctgagaagccagggaccaagatggatcttctcctcgacatcagctaagcctggaggactcttcccctcagagaccatggagagggacagccacgggtccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagaggtctgaatgcccttcccagcggtatatctctctccagtgttcccgtaagatgttcttcttcttggattgtggccagtgtcgtgtgggagtaaagggcagaggggcagcactcctccaagggaggtgtttggcacaggggttcaagtcaggaacagtgtcttagccagcaggcctgcttcag

SEQ ID NO: 193352 - DNA, 2592 bp, Homo sapiens
  Payload ID: 18174
  Gene Name: transmembrane protease, serine 13
  Uniprot ID: Q9BYE2
  ENST ID: ENST00000526090
  CDS Start-End: 153-1628
cacacgtcccaaccggcttccccgccccatttggtgggggctggcccttggccctccaactcctttaccctacatgcctgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccagcccaggcatctccagcccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccggtgagggaatctgcactccccgctctcctgccccccagccccagcaccctctgcagccctcgcacttgtcagcatctgtcaactcatatccgggccccaaagcttctgcagggcagaagtcaaagactcttaaagatccttacatggaacacttctgttttataattagggaaactgaagcccaagggttataaataagtttgctccaaatgacacatctcacattacaaattgatgacggagtcagggcttgggtactgatcttaatcaatagattgaattctttcactggtattaactgagcacctaggggccaaacgctatggtaggcatttcacacatatgatttcatttactcttcacaaccaaccctgtggagcaggcactattattaacttcatttgacatatgaggaaatggagctttacagagagataattacctgaggccacaagtaataggtggtagctctgggattggaaccaggtcgatctgattcccaagcagtgctctccccacctggctctagactggcaaattgcttaccctgcagtcgagaacttaagctgagtacacattcaaacaactaattgctacaacgttgttgctaaggaccaaaggaggctacacaaaggaaatgctgcagaggttctcagaagatcactgtggacaggggacgtcaaagaagacttcattcattcattcattcattcactcatcattcatccattcactcatttgttcacttatcaaatactatatggccagccctatagtacagttgcaaatagaaataaaatacaccaagacgaccagtagaggccaattatacgatgttttcggggagcagggagctatggtggcataggcgggagcaactaatcatcctggcaggctaggggaagctcagcagaggaaggatagccaaggtgggtcccgaaaagattggagaagacaggtaatgggggctcagggaggaccctgaagaatggagccagagccctctggcataagcatctgtaaaggtgggagagggaggaggagtaccgggatttctggaagcctcggaggactctctggttagtccagccattctcgtgctctgagcctgtgagctggtgtttcctcgcacattaattatggaggcggtgtctatca

SEQ ID NO: 193353 - DNA, 3266 bp, Homo sapiens
  Payload ID: 18174
  Gene Name: transmembrane protease, serine 13
  ENST ID: ENST00000614424
  CDS Start-End: 75-1763
tgagaagccagggaccaagatggatcttctcctcgacatcagctaagcctggaggactcttcccctcagagaccatggagagggacagccacgggaatgcatctccagcaagaacaccttcagctggagcatctccagcccaggcatctccagctgggacacctccaggccgggcatctccagcccaggcatctccagcccaggcatctccagctgggacacctccgggccgggcatctccagcccaggcatctccagctggtacacctccaggccgggcatctccaggccgggcatctccactccaggcatctccagcccgggcatctccggctctggcatcactttccaggtcctcatccggcaggtcatcatccgccaggtcagcctcggtgacaacctccccaaccagagtgtaccttgttagagcaacaccagtgggggctgtacccatccgatcatctcctgccaggtcagcaccagcaaccagggccaccagggagagcccaggtacgagcctgcccaagttcacctggcgggagggccagaagcagctaccgctcatcgggtgcgtgctcctcctcattgccctggtggtttcgctcatcatcctcttccagttctggcagggccacacagggatcaggtacaaggagcagagggagagctgtcccaagcacgctgttcgctgtgacggggtggtggactgcaagctgaagagtgacgagctgggctgcgtgaggtttgactgggacaagtctctgcttaaaatctactctgggtcctcccatcagtggcttcccatctgtagcagcaactggaatgactcctactcagagaagacctgccagcagctgggtttcgagagtgctcaccggacaaccgaggttgcccacagggattttgccaacagcttctcaatcttgagatacaactccaccatccaggaaagcctccacaggtctgaatgcccttcccagcggtatatctctctccagtgttcccactgcggactgagggccatgaccgggcggatcgtgggaggggcgctggcctcggatagcaagtggccttggcaagtgagtctgcacttcggcaccacccacatctgtggaggcacgctcattgacgcccagtgggtgctcactgccgcccactgcttcttcgtgacccgggagaaggtcctggagggctggaaggtgtacgcgggcaccagcaacctgcaccagttgcctgaggcagcctccattgccgagatcatcatcaacagcaattacaccgatgaggaggacgactatgacatcgccctcatgcggctgtccaagcccctgaccctgtccgctcacatccaccctgcttgcctccccatgcatggacagacctttagcctcaatgagacctgctggatcacaggctttggcaagaccagggagacagatgacaagacatcccccttcctccgggaggtgcaggtcaatctcatcgacttcaagaaatgcaatgactacttggtctatgacagttaccttaccccaaggatgatgtgtgctggggaccttcgtgggggcagagactcctgccagggagacagcggggggcctcttgtctgtgagcagaacaaccgctggtacctggcaggtgtcaccagctggggcacaggctgtggccagagaaacaaacctggtgtgtacaccaaagtgacagaagttcttccctggatttacagcaagatggagagcgaggtgcgattcagaaaatcctaaccagctggcctgctgctctgcacagcaccggctgctgtgaagactctggccatggtgactggccatgtgtggcatcatctgggctaatggccaccgggcaccatcggactcccacctccactgtctgctgcctctgtgtgtgtgtgtgtgtgtgtgtgtgtgtgtgcatatgtgtgcattgccactctcccaagtttttcagaaaccagcagagctgtcaactcttctcaaaatcccaggctggaaattacctggagacaagagttgagtaccgtggatgttcctacaggagtgtccatagatggatggaggaggtggagcccagagcccaaggaagagctgggaattcttgcttctctgaccctcacttacagactagcccagtgtgggcagatgccagcggcccaggtggcgccattgctgtcctgggatggatcgtgggttttggtggatgcagcttcccagggcctggaccgtcttcggtgaaaagctgctcccgttggctttatgagcatcaagtcctcacccagaccccctgctggtgccgtggatgtcaccagtcggactgtgctgtggctaaccaggctgacaactgagatgaggattcactgtactcatttggtcacaagctgctggggcgggttttattttattttatttttatatttaagaaatgaaaatacgggtatttttaaagattctccaaaaagtccagaagccttgacagctggcatcaatcagcccaagacccccaggggattcatgggaaatgtcgtattttagagtcctacagaatatttctggcctcaaggaactggatgaagagactggacaaagtccccaggatgggcatcccccaagtcactacagcatctggagcccctaggagatactcagggaagcaaatccttgtttgggctggcaagcaaatccgacacgacgaggtccacaaactgtttctgcatcccagggctctgacgaaggcgttaagaaacagatgctgttcccgcgtaggctcccaggggccccagggaggtccaggtggactgcctctctcattcccagtagctgtcctgggactttgggatttcttctcagctttctccacctttcagtttctcagttgtttcagaaacatagcaatgacataaaaactgctatggagagaaagctaacatggtcccatgccttccaggcagccctgctgaaggatctaagttggccctgttcctgcaaatcatcaacgtgcctggactcgccagctaaaagcctgggccttccccagccttttttctggggcacctattcctctgccagtcctgctcccctcaccttccttgggcccgtcagagtcttttgtggtgctgtgcttctcagaggcaggatccaagcagatcagcccagcctagcccagctcaggcaggccatggccgctcaagggaaagactgccccagaagagcaagctggagaggctgggcaggggctgatggggctgggtacac

SEQ ID NO: 193354 - DNA, 3947 bp, Homo sapiens
  Payload ID: 18175
  Gene Name: transmembrane protease, serine 15
  Uniprot ID: P98073
  ENST ID: ENST00000284885
  CDS Start-End: 35-3094
cagttcttaaattagcaagccttcaaaaccaaaaatggggtcgaaaagaggcatatcttctaggcatcattctctcagctcctatgaaatcatgtttgcagctctctttgccatattggtagtgctctgtgctggattaattgcagtatcctgcctgacaatcaaggaatcccaacgaggtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatgaaaatgtaaaagaagaactgattcaaggccttgaagcaaataaatccagccaactggtcactttccatattgatttgaacagcgttgatatcctagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttccctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagcgcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctcttaaataagttaattaaataaaagataaattaactgatatagtcattgtatattagataaattttacctatttatttcaagcaagtatttttaagtctcaagaaaataatcagacataccaaagaaatgcacctattgcaaatcctggtcttggtttatgtgtgttacagtggatatttctaatatatgaaaacttatttagacacagctgaatcacccatgagaaggtcaaatatgtgtaataaatgaatttgcttca

SEQ ID NO: 193355 - DNA, 754 bp, Homo sapiens
  Payload ID: 18175
  Gene Name: transmembrane protease, serine 15
  ENST ID: ENST00000422787
  CDS Start-End: 72-754
gcctgtcaccatgtaagaagtgaatttgctcctcgttcgccttctgccatgattgtgaggcctctccagccatgtggaactgtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatgaaaatgtaaaagaagaactgattcaaggccttgaagcaaataaatccagccaactggtcactttccatattgatttgaacagcgttgatatcctagcatctttggagaatttttctacagtaagccctgcaacaacttcagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacg

SEQ ID NO: 193356 - DNA, 452 bp, Homo sapiens
  Payload ID: 18175
  Gene Name: transmembrane protease, serine 15
  ENST ID: ENST00000474775
  CDS Start-End: 438-452
ttgaaggtgactgaatagaacaatagatagatctcacatgagtgagaggaattctacagcaggtagtctttgcctttgaactgcagcatgaactctcctctgggtctcccacctgccagcccaccctgcagagtttgcatttgctagcctccacaatcggaaatggcagcattatagtcgtatttgaccttttctttgcccagtgggtgtcagatgaaaatgtaaaagaagaactgattcaaggccttgaagcaaataaatccagccaactggtcactttccatattgatttgaacagcgttgatatcctaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtt

SEQ ID NO: 193357 - DNA, 3205 bp, Homo sapiens
  Payload ID: 18176
  Gene Name: transmembrane protease, serine 2
  Uniprot ID: O15393
  ENST ID: ENST00000332149
  CDS Start-End: 136-1614
cgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaa

SEQ ID NO: 193358 - DNA, 3240 bp, Homo sapiens
  Payload ID: 18176
  Gene Name: transmembrane protease, serine 2
  Uniprot ID: O15393
  ENST ID: ENST00000398585
  CDS Start-End: 62-1651
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagt

SEQ ID NO: 193359 - DNA, 1901 bp, Homo sapiens
  Payload ID: 18176
  Gene Name: transmembrane protease, serine 2
  ENST ID: ENST00000454499
  CDS Start-End: 435-1901
agcccaccagaggcaaaaagaggacagtctcacggtccccaagcccagagaccactgggaggggagcaagtggggtctggaccaccgaccttagcttcacctcaacccccaagaacacctgccccgttggaggcagactggagctggctgtggattttatttctcaggagaaggaggtgggagctggagagagtgacccgtgcatctttccagcttttccttggccacctgggtggcatgggagctgggagtcagagttctgctgagctgtaggaccaaaggccactggctccgctgcacctgcggactgagacacccacctgctgagtgagacccagcctctgcgtgcttaggggtcccctgctacagggcattgaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 193360 - DNA, 1701 bp, Homo sapiens
  Payload ID: 18176
  Gene Name: transmembrane protease, serine 2
  Uniprot ID: O15393
  ENST ID: ENST00000458356
  CDS Start-End: 90-1568
gtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggc

SEQ ID NO: 193361 - DNA, 454 bp, Homo sapiens
  Payload ID: 18176
  Gene Name: transmembrane protease, serine 2
  ENST ID: ENST00000455813
  CDS Start-End: 217-454
ctggctcctgagctgctgctgtgaagggaggacctggtgggctaggtaaccgggagctcccccagaaagtcactggaggttgctcaggacttccccacctttactgagtgcttttgaagaagtaggacctgccctgctccgctacagaactactggacaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaa

SEQ ID NO: 193362 - DNA, 726 bp, Homo sapiens
  Payload ID: 18176
  Gene Name: transmembrane protease, serine 2
  ENST ID: ENST00000424093
  CDS Start-End: 69-726
ggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcattcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 193363 - DNA, 3193 bp, Homo sapiens
  Payload ID: 18177
  Gene Name: transmembrane protease, serine 3
  Uniprot ID: P57727
  ENST ID: ENST00000291532
  CDS Start-End: 957-2321
ttctgcttttaatgatggcagctccagaaatggtgagtaaaatgggtgtgaggagagaagatgcttctcaacacttctcagtgttgtacagcttgccaaccacagcctgtttgggaggggatgttctcacccaggttccatctttcagaagccatttgcccacttattctttttatatggataaacgatgtaatttgctacatgctgataataaacagaggtatcagcaagaatgaaagccagaaaatggcccaacatgaacttcttgcttttctaagttactctttcaagctcttcttgcgatagaaatgaaatgaacatttttggcacagaactcttgtttagattttactatgatcttgggaaacacgggttgcttcaaatggcttactagatccctttggaatttcaaacgttacaacaggtagtcacaaagggaatgaaagcggatgatctgagtgtctgtgctgatgtgcctgctggagcccctgtggattttagcccttggaggaagcaggttcccagagcagccatgcctgatatctgggagagggaactagaatttaattgggaatcttctgctatttccctgcttcctccgccctctcagagttacagggaatgacttagaaaggtctctggtctccttggcattgtgataggtggaattctttcgtaggaaacacagccccggggttattttgatgcaagccgttggtccaaagccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctca

SEQ ID NO: 193364 - DNA, 1342 bp, Homo sapiens
  Payload ID: 18177
  Gene Name: transmembrane protease, serine 3
  Uniprot ID: P57727
  ENST ID: ENST00000398397
  CDS Start-End: 202-1236
accgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatggtacatctgggtctctatgtggttctgcagctcttcctttgtttcaagaggatttgcaattgctcattgaagcattcttatgatggctgctttataatccttgtcagatattaataattccaactcctgattcatgttggtgttggcatcagttgattatcttttctcattaaaattgtgatgctccta

SEQ ID NO: 193365 - DNA, 2754 bp, Homo sapiens
  Payload ID: 18177
  Gene Name: transmembrane protease, serine 3
  ENST ID: ENST00000398405
  CDS Start-End: 527-1882
atgtgagtaccgaaactacttatgcttatggtaggtgtaccacacgcacagggaaagaattgcgtttatgtgggacaggtgaaaacaatcgcaaaaaagcaatggaaagggctttgagagtaatttatcttctgaacaatagcaatatggcaacttctaaatggtgagagggagtccctctaaagcaatcgatttgaagattggttggacaaacaatgggaaagtcattgtcttagcagaattaagttcatactttttttttttttttttttttgctaattctagaagcttttctgttatctgctgtagctcagacgaaaatgcattctcaccagatgactgtttttggttaatcgatactgaatgcgctttgtgtggactgtcgaatttcaaagatttaccgtatgaccaagatgcacctgatgctacaagtataaataggggaacaaatgctttctgttcttcctcggctaaggaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctca

SEQ ID NO: 193366 - DNA, 2403 bp, Homo sapiens
  Payload ID: 18177
  Gene Name: transmembrane protease, serine 3
  Uniprot ID: P57727
  ENST ID: ENST00000433957
  CDS Start-End: 170-1531
cttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctca

SEQ ID NO: 193367 - DNA, 2074 bp, Homo sapiens
  Payload ID: 18178
  Gene Name: transmembrane protease, serine 4
  Uniprot ID: Q9NRS4
  ENST ID: ENST00000437212
  CDS Start-End: 215-1528
acacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcata

SEQ ID NO: 193368 - DNA, 725 bp, Homo sapiens
  Payload ID: 18178
  Gene Name: transmembrane protease, serine 4
  ENST ID: ENST00000524218
  CDS Start-End: 1-188
ggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatc

SEQ ID NO: 193369 - DNA, 692 bp, Homo sapiens
  Payload ID: 18178
  Gene Name: transmembrane protease, serine 4
  ENST ID: ENST00000522151
  CDS Start-End: 174-692
tgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaa

SEQ ID NO: 193370 - DNA, 1634 bp, Homo sapiens
  Payload ID: 18178
  Gene Name: transmembrane protease, serine 4
  ENST ID: ENST00000522307
  CDS Start-End: 584-1456
tcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaagtcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccaga

SEQ ID NO: 193371 - DNA, 1689 bp, Homo sapiens
  Payload ID: 18178
  Gene Name: transmembrane protease, serine 4
  Uniprot ID: Q9NRS4
  ENST ID: ENST00000523251
  CDS Start-End: 227-1420
cactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgtcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctca

SEQ ID NO: 193372 - DNA, 789 bp, Homo sapiens
  Payload ID: 18178
  Gene Name: transmembrane protease, serine 4
  ENST ID: ENST00000517544
  CDS Start-End: 1-445
ccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggtaagtgaggggacaccttctggcctacagaaggcccccacatggacgctgctcttcaggttgcaaccagctcacctggaaccccaagcagccaggggaatgtaagcagacatcaggaagaactcctagccagatggatcattcaatgccaagagctatagactcacattttggagaggttttctgtgttgacttgtttttaatacaatggacagctggacaaagtgtgttgtcctactcagagccagagggatggataatgtgacctttccatcaatctggatagtaaatagtttttgctactgctgtaggttttctaataaattgcccaataggcaagattccaaa

SEQ ID NO: 193373 - DNA, 1934 bp, Homo sapiens
  Payload ID: 18178
  Gene Name: transmembrane protease, serine 4
  ENST ID: ENST00000519236
  CDS Start-End: 233-1240
cccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatc

SEQ ID NO: 193374 - DNA, 2052 bp, Homo sapiens
  Payload ID: 18178
  Gene Name: transmembrane protease, serine 4
  Uniprot ID: Q9NRS4
  ENST ID: ENST00000522824
  CDS Start-End: 210-1508
gagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggca

SEQ ID NO: 193375 - DNA, 2074 bp, Homo sapiens
  Payload ID: 18178
  Gene Name: transmembrane protease, serine 4
  ENST ID: ENST00000517483
  CDS Start-End: 226-405
actcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcggtaagttcagatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgt

SEQ ID NO: 193376 - DNA, 5550 bp, Homo sapiens
  Payload ID: 18178
  Gene Name: transmembrane protease, serine 4
  Uniprot ID: Q9NRS4
  ENST ID: ENST00000534111
  CDS Start-End: 266-1573
gtagggctgttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcataggctagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggagccagggataacctatgacttgggaaagagatgagttaggcagtcaagggtgacattcaatcagggatccacaagtggctggaaagaaatgctggtcctgtgtcctaactttttccgcctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgccaaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccaccatccatctccagaacagaaactcagtacccatcaaacaactctccatttccccctcctcccaatctctggcaaccaccattgtgctttcagtctctgtgaactggattactctgggtacctcatttaagtgaagtcatgcagtattggtctttttgtacttgttttatttcacttcacattgtgtcttcaagtttcacccatgttgtagcatgtgtcagaatttcttccctttttagactaaataatattctattgtttatacgaacattcaggttacttctatcttttggctattgtgaattatgctgctgtgaacatgggtgtacaagtatctctttgaggccctgctttcaattctcttgggtatattcccagaagtggaattgctggatcatatggtaattctattttgaattttttgaggaactgatatattgctttccatagagactgcaccattttacattcccatcaacagtttgcaggagttactatttctccatatcccccctaacacttgctattttctgttaaaaatggatatcttaataatcaagcaaaaataacaggcagatttgaaaaagaactgaatacagcttttagaaataaaaactataattataaaaataaaaaactaagtggatggggtaaataacaattaaaacaccaattaagagagaacaaatgaactggaagataaattgaagaagtgactaggcttaacagcagagagagataaggagattaaaaatatgaaaacaaggccaggagcaatgaagcctagaatggtaaattctaacatatccagaatcccagaaagagagaatcaagacaatgagagagagacagtaccaaagagataagagctgagaatgttccagaattgataaaaggtgtgaatccacagaacatacaccaccatagtgtacacgcatacaaccaaggtggaaaaattagaataaatccacacctatgtacattataatgaaactgcagaacaccaaagacaaaaagaaactccttatagcagcagagagaaaacccagaccacccacagtaccacaaatctaccacaattagactgacaacaggctttcccacagcaataaaggagctagaagtcagtggaagtatatctccagcatgccaaaagataacaatcaatcagggattgtgaaccctacaaaactatctttcaagaataaaggcattttcaagaaaacaaaaacagactttaccatcaacaaaccttctctaaaagaatatataaagcatttactttaggaagaaggaaaatgatcctaaaaggaagaaccaagaagcaagtagcaatagtgaggcaattgtgaaaatgtaggtaagtctaaacacactctgtctacttcttcttcttcttcttcttcttcttcttcttattttgagactgagtcttgccctgtcacccagactggagtgcagtggcaggatcttggctcactgctatctccacctcccaggttcaagtgattcttctgcctcagcctcccgagtagctgggattacatgcacatgccaccatatccggctaatttttgaatttttagtagagatggggtttcactgtgttggccaggccggtctcaaactcccgacctcaagtgatccccccgcctcggcctcccaaagtgctgggattacaggcgtgtctacatattattaaaataacaataatatttattttgtgggttaattttttttgaaacagatattgaatttattggttggctatgagtagaaaaatacatcagtaaagaaaaaagaccctgtatataaatataatactagctagttaaaatttgaccaagaagtttccattgtgggttaatttttaaaggcctaactgaaatatggagtaaccacagcatgcagcatgtaaattaaaggggatagctgg

SEQ ID NO: 193377 - DNA, 3531 bp, Homo sapiens
  Payload ID: 18178
  Gene Name: transmembrane protease, serine 4
  Uniprot ID: Q9NRS4
  ENST ID: ENST00000618855
  CDS Start-End: 292-1605
atcattccagtttggcaacttcacttgtagggctgttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcataggctagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggagccagggataacctatgacttgggaaagagatgagttaggcagtcaagggtgacattcaatcagggatccacaagtggctggaaagaaatgctggtcctgtgtcctaactttttccgcctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgccaaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacatttt

SEQ ID NO: 193378 - DNA, 3417 bp, Homo sapiens
  Payload ID: 18178
  Gene Name: transmembrane protease, serine 4
  ENST ID: ENST00000616579
  CDS Start-End: 292-1491
atcattccagtttggcaacttcacttgtagggctgttttaatcaagctgcccaaagtcccccaatcactcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgtcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcataggctagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggagccagggataacctatgacttgggaaagagatgagttaggcagtcaagggtgacattcaatcagggatccacaagtggctggaaagaaatgctggtcctgtgtcctaactttttccgcctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgccaaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacatttt

SEQ ID NO: 193379 - DNA, 2056 bp, Homo sapiens
  Payload ID: 18178
  Gene Name: transmembrane protease, serine 4
  ENST ID: ENST00000610964
  CDS Start-End: 251-1519
gagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatc

SEQ ID NO: 193380 - DNA, 2232 bp, Homo sapiens
  Payload ID: 18179
  Gene Name: transmembrane protease, serine 5
  Uniprot ID: Q9H3S3
  ENST ID: ENST00000299882
  CDS Start-End: 150-1523
gggatacagggaggggccatgtgcgaaccagggagacctcatcttccaaccaagcttgctgggctagctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccatttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttg

SEQ ID NO: 193381 - DNA, 2001 bp, Homo sapiens
  Payload ID: 18179
  Gene Name: transmembrane protease, serine 5
  ENST ID: ENST00000540540
  CDS Start-End: 695-1291
gggagacctcatcttccaaccaagcttgctgggctagctttaatcaatgctggcctgagaacaggagcggaacattgcctagtagaccctgaggctttacaacagtgccactgacccctatgtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttgg

SEQ ID NO: 193382 - DNA, 1811 bp, Homo sapiens
  Payload ID: 18179
  Gene Name: transmembrane protease, serine 5
  ENST ID: ENST00000536856
  CDS Start-End: 658-1101
ctttaatcaatgctggcctgagaacaggagcggaacattgcctagtagaccctgaggctttacaacagtgccactgacccctatgtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcctgttctcacctggctgtggctggccctgtgtggggtgggtacactggaaaacaagaaggttggagttggtctaggacattggttttaaatgacagttctgtgaactggtccaaggagttctgttattaaagtgatatatggtcttgg

SEQ ID NO: 193383 - DNA, 1524 bp, Homo sapiens
  Payload ID: 18179
  Gene Name: transmembrane protease, serine 5
  ENST ID: ENST00000544634
  CDS Start-End: 79-1245
aatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccatttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatga

SEQ ID NO: 193384 - DNA, 583 bp, Homo sapiens
  Payload ID: 18179
  Gene Name: transmembrane protease, serine 5
  ENST ID: ENST00000538091
  CDS Start-End: 85-219
agctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccagtaggccagactgggccataggggaatgacagggtggggacagtggagggcaatcatcctacattccccggatcctccttggggtcagccccacatgattgatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacaggtgggctgcacccctaaggctacgggcctccctccccagcagggacctgtcacagctgagggcaaga

SEQ ID NO: 193385 - DNA, 2163 bp, Homo sapiens
  Payload ID: 18179
  Gene Name: transmembrane protease, serine 5
  ENST ID: ENST00000545579
  CDS Start-End: 254-1600
ccagggagacctcatcttccaaccaagcttgctgggctagctttaatcaatgctggcctgagaacaggagcggaacattgcctagtagaccctgaggctttacaacagtgccactgacccctatgagcctgatgctggatgaccaaccccctatggaggcccagtatgcagaggagggcccaggacctgggatcttcagagcagagcctggagaccagcagcatcccagtaggccagactgggccataggggaatgacagggtggggacagtggagggcaatcatcctacattccccggatcctccttggggtcagccccacatgattgatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcc

SEQ ID NO: 193386 - DNA, 581 bp, Homo sapiens
  Payload ID: 18179
  Gene Name: transmembrane protease, serine 5
  ENST ID: ENST00000539732
  CDS Start-End: 531-581
aatcaatgctggcctgagaacaggagcggaacattgcctagtagaccctgaggctttacaacagtgccactgacccctatgtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcgggg

SEQ ID NO: 193387 - DNA, 584 bp, Homo sapiens
  Payload ID: 18179
  Gene Name: transmembrane protease, serine 5
  ENST ID: ENST00000538770
  CDS Start-End: 553-584
aatcaatgctggcctgagaacaggagcggaacattgcctagtagaccctgaggctttacaacagtgccactgacccctatgtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggtaggactactgaggctgttaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccag

SEQ ID NO: 193388 - DNA, 1956 bp, Homo sapiens
  Payload ID: 18179
  Gene Name: transmembrane protease, serine 5
  ENST ID: ENST00000538955
  CDS Start-End: 152-1393
ccagggagacctcatcttccaaccaagcttgctgggctagctttaatcaatgctggcctgagaacaggagcggaacattgcctagtagaccctgaggctttacaacagtgccactgacccctatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccaggaacaactgcacttctggtcaagttgtttccctcagatgctctgagtgtggagcgaggcccctggcttcccggatagttggtgggcagtctgtggctcctgggcgctggccgtggcaggccagcgtggccctgggcttccggcacacgtgtgggggctctgtgctagcgccacgctgggtggtgactgctgcacattgtatgcacagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacaggtctctcctcttgggccctgatttcagagtcctctttctcactagagactcaatgacagaagagaggctgggacttggttgggcatgctgtggttgctgagggatgagggggaggagagaggtaggagctggagatgaagaggctgctagaagcagcaggaagcctgcccttctgccctctcccctccctgcccctgtgtgagtcttttgggagggtgctgggaggtgccccccgtcccacctttttcctgtgctctaggtgggctaagtgcctccctagaggactccatggctgagaggctcctgggcagatggggtcaaggctgggccagcccagatgaagcctatgggagtcaggaccctctccactctccctctccactccccttcc

SEQ ID NO: 193389 - DNA, 1320 bp, Homo sapiens
  Payload ID: 18179
  Gene Name: transmembrane protease, serine 5
  ENST ID: ENST00000544476
  CDS Start-End: 114-1148
agctttaatcaatgctggcctgagaacaggagcggaacattgcctagtagaccctgaggctttacaacagtgccactgacccctatgtttctcaggcagtgtgctggcgttccatgcgacgtggctgtgcagtgctgggagccctggggctgctggccggtgcaggtgttggctcatggctcctagtgctgtatctgtgtcctgctgcctctcagcccatttccgggaccttgcaggatgaggagataactttgagctgctcagaggccagcgctgaggaagctctgctccctgcacttcccaaaacagtatctttcagaataaacagcgaagacttcttgctggaagcgcaagtgagggatcagccacgctggctcctggtctgccatgagggctggagccccgccctggggctgcagatctgctggagccttgggcatctcagactcactcaccacaagggagtaaacctcactgacatcaaactcaacagttcccaggagtttgctcagctctctcctagactgggaggcttcctggaggaggcgtggcagcccagtttcaggctggcccgcctgtccagctggcgggttcatgcggggctggtcagccacagtgccgtcaggccccaccaaggggctctggtggagaggattatcccacaccccctctacagtgcccagaatcatgactacgacgtcgccctcctgaggctccagaccgctctcaacttctcagacactgtgggcgctgtgtgcctgccggccaaggaacagcattttccgaagggctcgcggtgctgggtgtctggctggggccacacccaccctagccatacttacagctcggatatgctccaggacacggtggtgcccttgttcagcactcagctctgcaacagctcttgcgtgtacagcggagccctcaccccccgcatgctttgcgctggctacctggacggaagggctgatgcatgccagggagatagcgggggccccctagtgtgcccagatggggacacatggcgcctagtgggggtggtcagctgggggcgtggctgcgcagagcccaatcacccaggtgtctacgccaaggtagctgagtttctggactggatccatgacactgctcaggactccctcctctgagtcctgctgtttcctccagtctcactgcacaccactgcctcatgcttcctggggcctccagcagctccactaatggaggagaggcagtagcctccgacacagaacgcatggacctcctactactgtgtgtgaggaacagtcactacccactggccagccacccagccaacag

SEQ ID NO: 193390 - DNA, 3197 bp, Homo sapiens
  Payload ID: 18180
  Gene Name: transmembrane protease, serine 6
  Uniprot ID: Q8IU80
  ENST ID: ENST00000346753
  CDS Start-End: 118-2553
gttcttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatccaa

SEQ ID NO: 193391 - DNA, 3260 bp, Homo sapiens
  Payload ID: 18180
  Gene Name: transmembrane protease, serine 6
  Uniprot ID: Q8IU80
  ENST ID: ENST00000381792
  CDS Start-End: 142-2616
cttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcgccctacgggcggatgctgtggccctattttatggatggagaaaccaaggctcagagacatgttgctgccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatccaa

SEQ ID NO: 193392 - DNA, 3178 bp, Homo sapiens
  Payload ID: 18180
  Gene Name: transmembrane protease, serine 6
  Uniprot ID: Q8IU80
  ENST ID: ENST00000406856
  CDS Start-End: 63-2537
ggacaaacagaggctcctgaggcctgtgtgcaggcccggcacctatctgccgctcccaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcgccctacgggcggatgctgtggccctattttatggatggagaaaccaaggctcagagacatgttgctgccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatc

SEQ ID NO: 193393 - DNA, 3122 bp, Homo sapiens
  Payload ID: 18180
  Gene Name: transmembrane protease, serine 6
  Uniprot ID: Q8IU80
  ENST ID: ENST00000406725
  CDS Start-End: 73-2481
gagccacctaccctgctccgaggccaggcctgcagggcctcatcggccagagggtgatcagtgagcagaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatc

SEQ ID NO: 193394 - DNA, 446 bp, Homo sapiens
  Payload ID: 18180
  Gene Name: transmembrane protease, serine 6
  ENST ID: ENST00000429068
  CDS Start-End: 1-216
ctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggagagtttgaatatctaagatgccagtcttggaagatgccaaaattggaaggctctggggctctagaattcttggatttctggggtgtgtgttcccaatcaccaacacttgtaatttgcttgttggctgatcctattcaaaaggatcatccagacaaaaggtgacgaagaatgacaaggtttgcttgactcctttttgcaatttatctgggactaggattaaaagaaaggagaagaaata

SEQ ID NO: 193395 - DNA, 1695 bp, Homo sapiens
  Payload ID: 18180
  Gene Name: transmembrane protease, serine 6
  ENST ID: ENST00000442782
  CDS Start-End: 118-1503
gttcttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggtaccacttcctctcctccctctggcttcctttcctccctccccctccctctcttccctcctcaatagtgaccccctcattggaagcccaagtccccaatctcagaggggcagcaaggggagcgagcagaggctggggctggtgtcaggcctgttgcccttgaccttgtcctcgtcccagcctccgccctggccccggcttcccctctggctaccccagaggtctcagacacgtttggtcatcagacaccttggatgtttattctaattacagcaaaattgtctcatcttcttgggtgctgtaaccccctctggcaccctcaatccttcaataaaatgtttccagagccaaagga

SEQ ID NO: 193396 - DNA, 526 bp, Homo sapiens
  Payload ID: 18180
  Gene Name: transmembrane protease, serine 6
  ENST ID: ENST00000423761
  CDS Start-End: 102-526
aaaaggcagggaagtcctgcttccgtgccccaccggtgctcagcagaggctcccttgcaaatgcgaggctgtttccaactttggtctgtttccctggcaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgctt

SEQ ID NO: 193397 - DNA, 2616 bp, Homo sapiens
  Payload ID: 18181
  Gene Name: transmembrane protease, serine 7
  Uniprot ID: Q7RTY8
  ENST ID: ENST00000452346
  CDS Start-End: 4-2535
ataatggacaaagaaaacagcgatgtttcagccgcacctgctgacctgaaaatatccaatatctcagtccaagtggtcagtgcccaaaagaagctgccagtgagacgaccaccgttgccagggagacgactaccattgccaggaagacgaccaccacaaagacccattggcaaagccaaacccaagaagcaatccaagaaaaaagttcccttttggaatgtacaaaataaaatcattctcttcacagtatttttattcatcctagcagtcatagcctggacacttctgtggctgtatatcagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgctgggcttcggtcggattactcgtcaaccataggatctgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctgg

SEQ ID NO: 193398 - DNA, 2317 bp, Homo sapiens
  Payload ID: 18181
  Gene Name: transmembrane protease, serine 7
  Uniprot ID: Q7RTY8
  ENST ID: ENST00000419127
  CDS Start-End: 83-2236
tcatctggctgctcatctgtatcctttataataaagaaggaatagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctgg

SEQ ID NO: 193399 - DNA, 2620 bp, Homo sapiens
  Payload ID: 18181
  Gene Name: transmembrane protease, serine 7
  ENST ID: ENST00000435737
  CDS Start-End: 169-558
ttgctgggagggtggcatgctccaactccacagggacagaagctcctactctagagacccttctggacctcgctgtaggtacttcttcatctggctgctcatctgtatcctttataataaagaaggaatagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgaagtcctggggctgactctcattgtctggattgactgacatgcctattcttgaaatgacttctttgactctgattggccagcctgggttatgtgcccacctctgaaactagggacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctggctcacacctgtaatcccagcacgttgggaggccgaggcgggcagatcacgaggtcaggaggtcaagaccatcctggctaacatggtgaaaccctgtctctactg

SEQ ID NO: 193400 - DNA, 617 bp, Homo sapiens
  Payload ID: 18181
  Gene Name: transmembrane protease, serine 7
  ENST ID: ENST00000460599
  CDS Start-End: 70-617
atgaggaaaggtggtgagagagagggcacatcaaagacaatagtgctcagagcagcttttacttattgaatgcctgctatatactggataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgctgggcttcggtcggattactcgtcaaccataggatctgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacag

SEQ ID NO: 193401 - DNA, 2377 bp, Homo sapiens
  Payload ID: 18181
  Gene Name: transmembrane protease, serine 7
  Uniprot ID: Q7RTY8
  ENST ID: ENST00000617607
  CDS Start-End: 39-2192
gtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctggctcacacctgtaatcccagcacgttgggaggccgaggcgggcagatcacgaggtcaggaggtcaagaccatcctggctaacatggtgaaaccctgtctctactg

SEQ ID NO: 193402 - DNA, 3331 bp, Homo sapiens
  Payload ID: 18182
  Gene Name: transmembrane protease, serine 9
  Uniprot ID: Q7Z410
  ENST ID: ENST00000332578
  CDS Start-End: 1-3180
atggagcccactgtggctgacgtacacctcgtgcccaggacaaccaaggaagtccccgctctggatgccgcgtgctgtcgagcggccagcattggcgtggtggccaccagccttgtcgtcctcaccctgggagtccttttggccttcctctctacacagggcttccacgtggaccacacggccgagctgcggggaatccggtggaccagcagtttgcggcgggagacctcggactatcaccgcacgctgacgcccaccctggaggcactgctgcactttctgctgcgacccctccagacgctgagcctgggcctggaggaggagctattgcagcgagggatccgggcaaggctgcgggagcacggcatctccctggctgcctatggcacaattgtgtcggctgagctcacagggagacataagggacccttggcagaaagagacttcaaatcaggccgctgtccagggaactccttttcctgcgggaacagccagtgtgtgaccaaggtgaacccggagtgtgacgaccaggaggactgctccgatgggtccgacgaggcgcactgcgagtgtggcttgcagcctgcctggaggatggccggcaggatcgtgggcggcatggaagcatccccgggggagtttccgtggcaagccagccttcgagagaacaaggagcacttctgtggggccgccatcatcaacgccaggtggctggtgtctgctgctcactgcttcaatgagttccaagacccgacgaagtgggtggcctacgtgggtgcgacctacctcagcggctcggaggccagcaccgtgcgggcccaggtggtccagatcgtcaagcaccccctgtacaacgcggacacggccgactttgacgtggctgtgctggagctgaccagccctctgcctttcggccggcacatccagcccgtgtgcctcccggctgccacacacatcttcccacccagcaagaagtgcctgatctcaggctggggctacctcaaggaggacttcctggtcaagccagaggtgctgcagaaagccactgtggagctgctggaccaggcactgtgtgccagcttgtacggccattcactcactgacaggatggtgtgcgctggctacctggacgggaaggtggactcctgccagggtgactcaggaggacccctggtctgcgaggagccctctggccggttctttctggctggcatcgtgagctggggaatcgggtgtgcggaagcccggcgtccaggggtctatgcccgagtcaccaggctacgtgactggatcctggaggccaccaccaaagccagcatgcctctggcccccaccatggctcctgcccctgccgcccccagcacagcctggcccaccagtcctgagagccctgtggtcagcacccccaccaaatcgatgcaggccctcagtaccgtgcctcttgactgggtcaccgttcctaagctacaagaatgtggggccaggcctgcaatggagaagcccacccgggtcgtgggcgggttcggagctgcctccggggaggtgccctggcaggtcagcctgaaggaagggtcccggcacttctgcggagcaactgtggtgggggaccgctggctgctgtctgccgcccactgcttcaaccacacgaaggtggagcaggttcgggcccacctgggcactgcgtccctcctgggcctgggcgggagcccggtgaagatcgggctgcggcgggtagtgctgcaccccctctacaaccctggcatcctggacttcgacctggctgtcctggagctggccagccccctggccttcaacaaatacatccagcctgtctgcctgcccctggccatccagaagttccctgtgggccggaagtgcatgatctccggatggggaaatacgcaggaaggaaatgccaccaagcccgagctcctgcagaaggcgtccgtgggcatcatagaccagaaaacctgtagtgtgctctacaacttctccctcacagaccgcatgatctgcgcaggcttcctggaaggcaaagtcgactcctgccagggtgactctgggggccccctggcctgcgaggaggcccctggcgtgttttatctggcagggatcgtgagctggggtattggctgcgctcaggttaagaagccgggcgtgtacacgcgcatcaccaggctaaagggctggatcctggagatcatgtcctcccagccccttcccatgtctcccccctcgaccacaaggatgctggccaccaccagccccaggacgacagctggcctcacagtcccgggggccacacccagcagacccacccctggggctgccagcagggtgacgggccaacctgccaactcaaccttatctgccgtgagcaccactgctaggggacagacgccatttccagacgccccggaggccaccacacacacccagctaccagactgtggcctggcgccggccgcgctcaccaggattgtgggcggcagcgcagcgggccgtggggagtggccgtggcaggtgagcctgtggctgcggcgccgggaacaccgttgcggggccgtgctggtggcagagaggtggctgctgtcggcggcgcactgcttcgacgtctacggggaccccaagcagtgggcggccttcctaggcacgccgttcctgagcggcgcggaggggcagctggagcgcgtggcgcgcatctacaagcacccgttctacaatctctacacgctcgactacgacgtggcgctgctggagctggcggggccggtgcgtcgcagccgcctggtgcgtcccatctgcctgcccgagcccgcgccgcgacccccggacggcacgcgctgcgtcatcaccggctggggctcggtgcgcgaaggaggctccatggcgcggcagctgcagaaggcggccgtgcgcctcctcagcgagcagacctgccgccgcttctacccagtgcagatcagcagccgcatgctgtgtgccggcttcccgcagggtggcgtggacagctgctcgggtgacgctgggggacccctggcctgcagggagccctctggacggtgggtgctaactggggtcactagctggggctatggctgtggccggccccacttcccaggtgtctatacccgggtggcagctgtgagaggctggataggacagcacatccaggagtgaccaccacgtgactgcccaggccgagactctacgtgaaagcaacaggagcagcaggccacccaacaccccaccccaccgtaccctacccaaggacgggtgtgggggggctgtgggtcatggggatgcattttggtaccaccctttgttccaa

SEQ ID NO: 193403 - DNA, 2568 bp, Homo sapiens
  Payload ID: 18182
  Gene Name: transmembrane protease, serine 9
  ENST ID: ENST00000613480
  CDS Start-End: 1-2568
atggagcccactgtggctgacgtacacctcgtgcccaggacaaccaaggaagtccccgctctggatgccgcgtgctgtcgagcggccagcattggcgtggtggccaccagccttgtcgtcctcaccctgggagtccttttggccttcctctctacacagggcttccacgtggaccacacggccgagctgcggggaatccggtggaccagcagtttgcggcgggagacctcggactatcaccgcacgctgacgcccaccctggaggcactgctgcactttctgctgcgacccctccagacgctgagcctgggcctggaggaggagctattgcagcgagggatccgggcaaggctgcgggagcacggcatctccctggctgcctatggcacaattgtgtcggctgagctcacagggagacataagggacccttggcagaaagagacttcaaatcaggccgctgtccagggaactccttttcctgcgggaacagccagtgtgtgaccaaggtgaacccggagtgtgacgaccaggaggactgctccgatgggtccgacgaggcgcactgcgagtgtggcttgcagcctgcctggaggatggccggcaggatcgtgggcggcatggaagcatccccgggggagtttccgtggcaagccagccttcgagagaacaaggagcacttctgtggggccgccatcatcaacgccaggtggctggtgtctgctgctcactgcttcaatgagttccaagacccgacgaagtgggtggcctacgtgggtgcgacctacctcagcggctcggaggccagcaccgtgcgggcccaggtggtccagatcgtcaagcaccccctgtacaacgcggacacggccgactttgacgtggctgtgctggagctgaccagccctctgcctttcggccggcacatccagcccgtgtgcctcccggctgccacacacatcttcccacccagcaagaagtgcctgatctcaggctggggctacctcaaggaggacttcctggtcaagccagaggtgctgcagaaagccactgtggagctgctggaccaggcactgtgtgccagcttgtacggccattcactcactgacaggatggtgtgcgctggctacctggacgggaaggtggactcctgccagggtgactcaggaggacccctggtctgcgaggagccctctggccggttctttctggctggcatcgtgagctggggaatcgggtgtgcggaagcccggcgtccaggggtctatgcccgagtcaccaggctacgtgactggatcctggaggccaccaccaaagccagcatgcctctggcccccaccatggctcctgcccctgccgcccccagcacagcctggcccaccagtcctgagagccctgtggtcagcacccccaccaaatcgatgcaggccctcagtaccgtgcctcttgactgggtcaccgttcctaagctacaagaatgtggggccaggcctgcaatggagaagcccacccgggtcgtgggcgggttcggagctgcctccggggaggtgccctggcaggtcagcctgaaggaagggtcccggcacttctgcggagcaactgtggtgggggaccgctggctgctgtctgccgcccactgcttcaaccacacgaaggtggagcaggttcgggcccacctgggcactgcgtccctcctgggcctgggcgggagcccggtgaagatcgggctgcggcgggtagtgctgcaccccctctacaaccctggcatcctggacttcgacctggctgtcctggagctggccagccccctggccttcaacaaatacatccagcctgtctgcctgcccctggccatccagaagttccctgtgggccggaagtgcatgatctccggatggggaaatacgcaggaaggaaatgccaccaagcccgagctcctgcagaaggcgtccgtgggcatcatagaccagaaaacctgtagtgtgctctacaacttctccctcacagaccgcatgatctgcgcaggcttcctggaaggcaaagtcgactcctgccagggtgactctgggggccccctggcctgcgaggaggcccctggcgtgttttatctggcagggatcgtgagctggggtattggctgcgctcaggttaagaagccgggcgtgtacacgcgcatcaccaggctaaagggctggatcctggagatcatgtcctcccagccccttcccatgtctcccccctcgaccacaaggatgctggccaccaccagccccaggacgacagctggcctcacagtcccgggggccacacccagcagacccacccctggggctgccagcagggtgacgggccaacctgccaactcaaccttatctgccgtgagcaccactgctaggggacagacgccatttccagacgccccggaggccaccacacacacccagctaccagactgtggcctggcgccggggaacaccgttgcggggccgtgctggtggcagagaggtggctgctgtcggcggcgcactgcttcgacgtctacggggaccccaagcagtgggcggccttcctag

SEQ ID NO: 193404 - DNA, 1747 bp, Homo sapiens
  Payload ID: 18183
  Gene Name: transmembrane protein 100
  Uniprot ID: Q9NV29
  ENST ID: ENST00000424486
  CDS Start-End: 304-708
ggaacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtggaa

SEQ ID NO: 193405 - DNA, 720 bp, Homo sapiens
  Payload ID: 18183
  Gene Name: transmembrane protein 100
  ENST ID: ENST00000571679
  CDS Start-End: 333-720
cacttcagaccacaaatccccacctcattttcaatgaattttttgctgaactgtccacctaaagtgggtaataaaaagatcccagggagcaggttgcactgtgtttaatagtaacacaataaagatttgttggctgtcattcaatggagaagaacatcatttgttgctggccacttgccttgacattgattttgtgggcagccaatgggtgatagtttgcaaagaatgcatgttatgcccagcaagattggcggagtctgagttgctctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcaga

SEQ ID NO: 193406 - DNA, 1962 bp, Homo sapiens
  Payload ID: 18183
  Gene Name: transmembrane protein 100
  Uniprot ID: Q9NV29
  ENST ID: ENST00000575734
  CDS Start-End: 810-1214
cagttgcttctacaaaacccgtgaaagttctctgtccaaaagccttgttggtcccgcggtacatgcttcctgttcccagagagattcacccttgggctttcctatcagtcttccctaaagttggctgctcctgtgtcctgtcacataaaactgtgaaccgaggtctccgacttacgtcatgtcagtcacagcagggtgaggctccacaagtgtgagttctggcccctgctgctttcctttcaaatgcagtttacagtttattatggtattggacaccccatgctccttactgcattggctttgggtaagaaggagtgaaaattagtgtgcgaacctgaaaacctagaatttctgattgggactgaagaaaacctttgtgctgcagtcagtccccgagccagacgcctgtgactctcttcacatggaaatagatgactatccacagtaaaagcaaaattaaaaagtgacttgtgaaaaatatcctccatgctcctcttaccaagcctgcaacttaaaacctatggtttaaactgtgctttcaattatctggaggaggccagcactgatgagcccatcctgagccagtcattttaaggccagtgctacctaactgagacaaggctaatctggtcgccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgct

SEQ ID NO: 193407 - DNA, 1536 bp, Homo sapiens
  Payload ID: 18184
  Gene Name: transmembrane protein 101
  Uniprot ID: Q96IK0
  ENST ID: ENST00000206380
  CDS Start-End: 26-799
ccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgcgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatag

SEQ ID NO: 193408 - DNA, 593 bp, Homo sapiens
  Payload ID: 18184
  Gene Name: transmembrane protein 101
  ENST ID: ENST00000586174
  CDS Start-End: 583-593
aaaagagctagggtcctagattgtgccgaagcttcatgagacctctcctcgtctgtgcacggacgagtggccgactctggagcccaggctgttgtttcctagtctggtggtgaatccgccatagtctggtgagtgcagtgtccgactctcgagcccaggctgttgctgttgcttcccagtctggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagc

SEQ ID NO: 193409 - DNA, 965 bp, Homo sapiens
  Payload ID: 18184
  Gene Name: transmembrane protein 101
  ENST ID: ENST00000587529
  CDS Start-End: 1-516
atggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggtatgttgggggactgttggttggaggtgcctggctgggagtgaactgtgagtctaggcatggcagaaccccaggaaggtagacacagaacgaggccctgagtgcagttcctgatggcccagttccctgggaattgccctggccagcttctaggcctcaggggccctccaaatgcctgttgagaggcccttcctccaacagtgttgccacgaggtagactggccattaaatttcaaccctgagagccaggagaacaagatggggtgattctctcatggctccagcccccaaaggactagaaggggataaaggagaggtttggtgggggtcaggccccagctgggactctgccccctagagctgatgagagctctagggtagccacttatggttctccctggtgctaggggaggccagggtgactggagacatggacaggcgccaggccattaggtcttatcttaattaccgagtatatctctgtacagctctctgtgtgg

SEQ ID NO: 193410 - DNA, 682 bp, Homo sapiens
  Payload ID: 18184
  Gene Name: transmembrane protein 101
  ENST ID: ENST00000585950
  CDS Start-End: 392-682
ggacgagtggccgactctggagcccaggctgttgcttcccagactggtggtgaatcctccatagtctgactatttaatcagcaggcagatcaacaggccaaaatttccaccataactgcaaacttgaatgcggatgaatggattacaacatggtcaaaccttgcaatgagaggcattataatggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtg

SEQ ID NO: 193411 - DNA, 573 bp, Homo sapiens
  Payload ID: 18184
  Gene Name: transmembrane protein 101
  ENST ID: ENST00000590905
  CDS Start-End: 420-573
attacaaaagagctagggtcctagattgtgccgaagcttcatgagacctctcctcgtctgtgcacggacgagtggccgactctggagcccaggctgttgtttcctagtctggtggtgaatccgccatagtctggtgagtgcagtgtccgactctcgagcccaggctgttgctgttgcttcccagtctggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgt

SEQ ID NO: 193412 - DNA, 1830 bp, Homo sapiens
  Payload ID: 18184
  Gene Name: transmembrane protein 101
  Uniprot ID: Q96IK0
  ENST ID: ENST00000589334
  CDS Start-End: 317-1090
ccagactgcgccgaagcttcatgagacctctcctcgtctgtgcacggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgcgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 193413 - DNA, 576 bp, Homo sapiens
  Payload ID: 18184
  Gene Name: transmembrane protein 101
  ENST ID: ENST00000592127
  CDS Start-End: 311-576
gaagcttcatgagacctctcctcgtctgtgcacggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgtt

SEQ ID NO: 193414 - DNA, 1973 bp, Homo sapiens
  Payload ID: 18185
  Gene Name: transmembrane protein 102
  Uniprot ID: Q8N9M5
  ENST ID: ENST00000323206
  CDS Start-End: 274-1800
gtgggcatcaggaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagtggtgtccgtggcgggctggcccgagggggctcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcctaccagtggaaagtgcctctgtgggcgagcgggacgtggggggccctgctcgcccctcgccagggggactgactgtgtgccctgggcctgaagccccccttctggaagacctccctgttggttcctcctctacgcccacccgcctgcccccgcacaagttg

SEQ ID NO: 193415 - DNA, 1962 bp, Homo sapiens
  Payload ID: 18185
  Gene Name: transmembrane protein 102
  Uniprot ID: Q8N9M5
  ENST ID: ENST00000396568
  CDS Start-End: 419-1945
gaagaagtaacctgttgaatctatttctgctccccacccttactgcttcccataagggggaagccgcagactaataagcctcttccaaaaaagaggtaaagggaggtagacaaggggcggcagcggaggctggctactgcattccgtaggaggagccaacagttactttttacctgctgagtccggtgaaccagttcatgggggcggggacctgcctatgagaaaagggccaggatagaagaggtatttatttgttcattttgaggactaaatttagaacccatcatctacagacccatttgtaggttgtgtctggggcactcgctcggcctcaggaagagggaagaacggggacgactttgtggcagcaaagccacctcccttccgtgttttccgcagcccaaagcgatagaaccgcatggcttccgcagtctgggggagtgccccctggtggggcccgccgcccccggccccagctcggccgctcacggacatcgacttctgctccggggcgcagctgcaggaattgacccagctgatccaggagctgggtgtgcaggagagctggagtgacgggcccaagccgggagccgatctcctccgggccaaggactttgtcttctctttgcttggtctagttcaccgccgggaccctcgctttcctccccaggcagagctcttgctgcttcgtggtgggattcgcgagggctccctggatctggggcatgcacccctgggtccctacgcccggggacctcactacgatgccggcttcacactcctagtgcccatgttttcactggacggcactgaactgcaactggacctggaatcctgttacgcacaggtctgcctcccagagatggtgtgcggaacccccatccgggagatgtggcaggattgcttaggacccccagtcccaggagcacgtgattcgatccaccgaacggagagcgaagaaagttccaaggactggcaaagctctgtagaccagccgcacagctacgtcactgagcacgaggcgccggtgtctttggaaaaatcgcctagtgacgtttcagcgtccgagtcgcctcagcatgacgtcgtcgaccttggctctaccgcacctttgaaaacaatgagtagtgacgtcaccaaggcagccgtcgaaagcccagtcccaaagccgtcggaggctcgggaagcgtggcccacattatgttccgcccaggtggctgcctggttctttgctacgctggcggcggtcgccgagtctctgatccctgtcccgggtgctccgcgtctggtgcacgcagctcgccacgcgggtttcaccaccgtcctcctggctacccctgagccccctcgccgcctcctgctcttcgacctgatcccagtggtgtccgtggcgggctggcccgagggggctcggagccactcgtgggccggtccgctggcctctgagtcggcttccttctacctggtgcccggtggcggcaccgagcggccgtgcgcctccgcctggcagctctgttttgcccgccaggagctggcgctcaaagcgcgcataccagcgccgctgctgcaggcgcacgcggcggcccaggcgctactgcgcccgctggtggccgggacccgggcggcggcgccctacctcctgcggacgctgctgtactgggcgtgcgagcggctgcctgcgctctacctggcgcggccagaaaatgcgggcgcctgctgcctcgggctgctagacgagctcggccgagtgctcgaggccgggacgttgcctcactattttctgaacggccgacagctccgtacgggggacgactccgctgcgctgctcggagaattggcccggctccgcggggacccggcccgggccctccgtgccgcggtggaggaggccaaagtggcccgcaaggggggcggtttggcgggcgtggggggcggggcccattaaagacgctgttcctacca

SEQ ID NO: 193416 - DNA, 4745 bp, Homo sapiens
  Payload ID: 18186
  Gene Name: transmembrane protein 104
  Uniprot ID: Q8NE00
  ENST ID: ENST00000335464
  CDS Start-End: 163-1653
ggcgcatgcgcgctgcggaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcgtgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctacctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgatacctgtttcccacatcactcaccagcc

SEQ ID NO: 193417 - DNA, 1781 bp, Homo sapiens
  Payload ID: 18186
  Gene Name: transmembrane protein 104
  ENST ID: ENST00000417024
  CDS Start-End: 147-1130
ggaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgtgtttgtcagagtggtcaagccaaacaaaatcgccatgctgtttataatgttaatcccgggctgggcacggtggctcacgcctgtaatcccagcactttgggaggctgaagcgggcagatcacctgaggtcaggagttcaagaccagcctggccaacatgcttcgtgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgat

SEQ ID NO: 193418 - DNA, 4679 bp, Homo sapiens
  Payload ID: 18186
  Gene Name: transmembrane protein 104
  Uniprot ID: Q8NE00
  ENST ID: ENST00000582330
  CDS Start-End: 123-1613
ggcgccggcagcagcggaccggcgggagacggcggcttgggagctggctgtgctgcagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcgtgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctacctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgata

SEQ ID NO: 193419 - DNA, 1740 bp, Homo sapiens
  Payload ID: 18186
  Gene Name: transmembrane protein 104
  Uniprot ID: Q8NE00
  ENST ID: ENST00000582773
  CDS Start-End: 146-1090
gaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcgtgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtga

SEQ ID NO: 193420 - DNA, 534 bp, Homo sapiens
  Payload ID: 18186
  Gene Name: transmembrane protein 104
  ENST ID: ENST00000578764
  CDS Start-End: 146-534
gaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtg

SEQ ID NO: 193421 - DNA, 3321 bp, Homo sapiens
  Payload ID: 18187
  Gene Name: transmembrane protein 105
  Uniprot ID: Q8N8V8
  ENST ID: ENST00000332900
  CDS Start-End: 551-940
acactgcgtccccatcagctcaaagaatacgcatggggacaagcctggggggccgtctgagagtcccccaaccctggatccccacggcagcccccactgttgggtttttcagtggctggtgtgccctgggctggtcacctctgcattttgctctgctgggagtttgctcctggccctccaacagcgcctcctctgtgaggaggaactcctgttcccgtggctctgctggctctggaggctggagttcccgtgctgggccctcctgggcgggttctctcttgctgccgccagtaccctgcccctctcgtcctcctgggtagcctgggaggaatggcagaagaaagcagtgaagccaggtagcagtagcccggccaccccaccaggctctgctgtaggctgggctctcaaggcagctgctccaggaggggccccctaggaagggactgccacactcctgggagcgttcctggccccctccagtgcaaatgaccctgggccccaaggctccgaacacccgcccctctgctccaggctagcttggctgagcccgatgcttctcaaggtgaggagggcgtccttgaagcctccggccaccccacaccaaggagctttcagggcaggaaatgtgatcgggcagctgatttatctccttacctggtctttgttcacagcctggctccggccccccaccctgctgcagggcccgaggacgtctccccaggggtccccacctcggtctccttggggggactgtgctgagcccagctgcctctgtgagatgaagataagaaggcgaagacatgaagggcctgcctgggggcagtctggctttcttgcaggggggctgcacctggttccctcctccctctcgctggcagcctgcggggtggtgaggatgaaggggctgtggggccggggtgcagggattagagggaggtgactgccatctcttcctcctcatcgtgtttttcacctcttaagtcaactttagattctcggactcagagttctctcctgacggtggcagggtcctcagatcaccggtgcagacagggccagacagggccaatgtggggacccactcagcctgtggcctctgcaggagggaggtcggaggcctcagcagccaccccggccacctcctgaaacagtgaatgtccttcattttcagctggcaagctctgatcttacaacgaggtatggaactgttcagaaaactttcagcagacgttcgagggaaaacagctcagcttcccatgccccccacctctgccaggagcgaccccatatcccccaaacagaattctggtagcccgggaccacagggtcttcctgtgcctcccctgccagctctgcatgactttgtcacgtacttgagtgctggctgagatgatgctaccgctaccaaacaggtgggaggccagccccagccccagccccagccccaccggggccggagctcccggtgaagaagcgtctgcctggttcgcaggtgtccaggacacaccagtcgcctgactcccggtcaggcaaacgcacacatcaagttcttgcaagccagggctctgctggcatcttcaagaggagggagggtcctggccctgaccacagggctcccttaacaggaggagttacaaactcggcttcctggggggcatcgtggggtgtgctgcctgccaggagaccccactcctggtcacggggttccgtcccacacagtggcaggagccatgcatgattcttggctgaagaagaacccgcacagctatgtggtctgccgcccagcagggaagcccccacatcagccctaagggaacttcccaaagctcagcaggtgcctcttcctgccatccgctaggtcttctcttggcccctctcccaagccttgacccatagctgacacttctagaaaagtctttaccgagaaacggaccggctgcatgggtggtgaggagggcagttgcccagggcctggcatcagaggggcctgtggctaaggctgtcctgaaattcttaatcattttacctctgaacttgcgggtttttgttgttgttttttgaggcagagtcttgctctgtcacccaggctggagtgcagtggtgcgatcttggcttactgcaacttccgactcccaggttcaagcgattctcctgcctcagcctcccgagtagctgggactacagaagtgcaccaccacacccggttaatttttgtatttttagtagagacggggtttcaccatgttggccaggctgatctcaaactcctgatacacccgcctcggcctctcaaagcactgggattacaggtgtgagccaccgcgcccggcccttttcctgcctcctaaacaagtggccaggaattctcctcctgcaccgggtccccagattgtgtggcaagccctgcagatggcacaggggactggttcttcctcgtggaaagccaggcccggacacctctcgggcatcgcctgttggggtgaccctcccacacccagcctggaaccctagccagctcagcctccgtccgctgagaaatcaaggtgaccttgtggctcagccctcagggggcactcaccacacaagagttccctttcaagaccccctgttcggggctggggcccccaggaacggttggggcaccttcctggggccctgtttttccccaggagcggggcctgggagctgagggcgtctcatctccccacaggcatctgctgctgctcctggctgccactcacccctgtgagatgctgagggcaggatacctgtctgtgcggggcgtgggaaaaagggagaaagcctggcagagggttgggggctaagaagcaaagggcgtggaagggccaccgtgcacttttgaagtctctacttgccagtggccaccccacctctccctgccctcatccaaggacggacaggcctggcaggtggaccggagctgtggggcagaagcatcccaggcctggcctcagaggagggaggccatggtgaaagtggaggctgtctgcatccacctccccagcctttgtcaccgggacctcagcctgaccccaggcccaccccaggctgctcaccgaggtgggtaccctgcccaccgccagctcagatgcggtgtgtggactcccttctctctgggggtgagcgggagttccctcccctccacatcaggagctgggggagagctggagggccctgggatccccttgaccctggtcatcagccccagccctgacaggccctgcgtgtgccatgtgtggcctgggtttggagctcagcaccctgcgggaattctattaaatctccgattttatctgaaaa

SEQ ID NO: 193422 - DNA, 513 bp, Homo sapiens
  Payload ID: 18187
  Gene Name: transmembrane protein 105
  ENST ID: ENST00000574093
  CDS Start-End: 292-513
ctcctgggcgggttctctcttgctgccgccagtaccctgcccctctcgtcctcctgggtagcctgggaggaatggcagaagaaagcagtgaagccaggtagcagtagcccggccaccccaccaggctctgctgtaggctgggctctcaaggcagctgctccaggaggggccccctaggaagggactgccacactcctgggagcgttcctggccccctccagtgcaaatgaccctgggccccaaggctccgaacacccgcccctctgctccaggctagcttggctgagcccgatgcttctcaaggtgaggagggcgtccttgaagcctccggccaccccacaccaagcctggctccggccccccaccctgctgcagggcccgaggacgtctccccaggggtccccacctcggtctccttggggggactgtgctgagcccagctgcctctgtgagatgaagataagaaggcgaagacatgaagggcctgcctgggggcagtctggctttcttgca

SEQ ID NO: 193423 - DNA, 1181 bp, Homo sapiens
  Payload ID: 18188
  Gene Name: transmembrane protein 106A
  ENST ID: ENST00000536052
  CDS Start-End: 70-717
attttcgattccactctcttccgtttctgtcgctgcagtcgtccgcggtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactga

SEQ ID NO: 193424 - DNA, 1330 bp, Homo sapiens
  Payload ID: 18188
  Gene Name: transmembrane protein 106A
  Uniprot ID: Q96A25
  ENST ID: ENST00000541594
  CDS Start-End: 238-882
attttcgattccactctcttccgtttctgtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacct

SEQ ID NO: 193425 - DNA, 1437 bp, Homo sapiens
  Payload ID: 18188
  Gene Name: transmembrane protein 106A
  Uniprot ID: Q96A25
  ENST ID: ENST00000588659
  CDS Start-End: 260-1048
attttcgattccactctcttccgtttctgtcgctgcagtcgtccgcggtgcggcacattcgttcccctaggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttct

SEQ ID NO: 193426 - DNA, 913 bp, Homo sapiens
  Payload ID: 18188
  Gene Name: transmembrane protein 106A
  ENST ID: ENST00000588693
  CDS Start-End: 190-913
gggcactgagtcaaagcttgaggggagtgttcgctcccgcattttcgattccactctcttccgtttctgtcgctgcagtcgtccgcggaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagct

SEQ ID NO: 193427 - DNA, 3266 bp, Homo sapiens
  Payload ID: 18188
  Gene Name: transmembrane protein 106A
  Uniprot ID: Q96A25
  ENST ID: ENST00000612339
  CDS Start-End: 238-1026
attttcgattccactctcttccgtttctgtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggctgtcccgtctgaatgtggagagagctgtagttttatctggcttttaaaacatggacctgccggctgggcgcagtggcttacacctgtaatcccagtactttgggaggccgaagtgggtggatcacttgagggcaggagttcgtgaccagcctggtcaacatggtgaaaccttgtctctactaaaaatacaaaaattagctgggtgtggtggcatgcgcctgtaatcccagctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtcttacagctgggtgcagtggtatatacctgtagtcccagctactcaggaagctgaggtgagaggatctctagagcccaggaattcaagtttaacatgagcagcaacattagcaagaccccgtttaaaaaaaaaaaaagagctgggcgtaatggcgcacacctgtaatcccacctactcaggaggctgaggcaggagaatcacttgaacctgggaggcagaggttgcagtgagccaagatcgcaccactgcactccagcctgggcaacaagggcgagactctgtctcaaaaaaaaaaaaaaaaaaagatggctgtctctttatcattcagacagaacgatgaacacaggtgagcagggaaagctaattttgaagtaggatgcatggagagggagaagtggtgacagaacttggtaactagctggctgggggaacgaggggaaggaaggagactgctgtctccaagctgaggtcagggtggtgttggcaagagcgcaaaagtccagggaagccaggctggagctgctgtgtatagactgccaaatgtgaagtatttatattgtattcaataaactatacttaagagtgttcaaaaaa

SEQ ID NO: 193428 - DNA, 12539 bp, Homo sapiens
  Payload ID: 18189
  Gene Name: transmembrane protein 106B
  Uniprot ID: Q9NUM4
  ENST ID: ENST00000396667
  CDS Start-End: 323-1147
acggcggccgcgcgctccaggccggtcgctccaccccccggctcccgggactgtggactccacgaccctgtcctcggccctgtccgcgccgaagcagcccgggactgcgcagcgccccgcgtgccgatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaagtctattactcatggaagacttttaaagaataaccttttttcctgttttataaattcccattgttatatggtagtatttcagctacacaatattttagcttttagctagacatttatagcttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacatgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaatcactttgcacatcacttggaatatgatgcctctagtagttacttttttatagttttctacttttggttttatttaaaattgttttcaaatatagattattgacttattcaactttgctgttttatattttcagtatcatttttcatttttttttttttttgtcttttcacttaccaagttctagggacatttaaaatatgtactaagtgtaggagtggttatgataccaaaaaatgtagctgggttgagattaatttcgttctgttttctcatgacagaaatcaggtttccctttccccacccctaagtgcctaacttaggtctgaaacagcctgtttattagtctgactctctcaaccataaaacataagctttatttaattctgcctttaaacacactcaggtttccccttaattttcatattattttctgcaagttttcttgagtatcttcaattcgttgaatgtggtttttggtttttttttgttttaacactagtcttcccttaattcattgctaactcaagccatccttactattaaacccaaatcagtcctttaagttcattatggcctttctagtatttaaaaaaaaaaaaatcattttcatttttcttctgctacgtttcctgactactactgcatacttctctgatacaggttctgtttgtattttttatatcattctcattttctcatttgacatgatctatgtctatatatgatataggtccccttttgtctcaaaatttttaattatgtgacttcaaaaatcacctgtatctgtagtagggcttccaaatctgcttctccatatgtgaccagtcacctgtctgctttcacatttagctagtgaactacacatttactaaaatgtgtaaattttacacatttagtgactgtgtaaaataaaaaaaaagttattttatcatatcctttctattatgttcccatcctgtcctcatgtcccatttactttattatcaccattcatttcttcaaaattatcttttagatacgctcatacaaaaatcaatccttgttttcttgcttgtgtcttttaaccttggaaaattacatcgtgtaaattaaacagatttttctgatgatctgtgcttcttatatactattagagtgcatgatagtatctcctgaaaaggatggaaagtagaagcatttgcttttagtcacttaattttgaatcttttttcttcatcttttgaattaattttttttattatatctacttttagtggagtttgagtcagaaaaaaacaagaatttgaaacaagtaaaaagatagaagagaaataaagatggtatgtgactactttcagagagagttaagtaactgtcagaataagcctggaacaaaacaggctgtaaattaataaaactacaaacacacattcaggtgaagcagaagtatagccataaaacatctagaaagagtgaatgaggcttttagcttttcttaggtcaatgtccagtgtgcttttttccatgggaataggataggtattaatacgcttttctaaactgctctcagaccttatccagaggacatggtaaagatatgttacagaaatttttctgatacttcctggaataactttaagttacaccctagtagactggtcattctaataaaatccagtactataacaaacctctgtatgttgatagcacattggccctttttagagttctttcctatgtttttcttacgtgatttcccacagttccatgagtccaacaaaggagagtgataggctccttatcttttagaagaggaaggaaaggcatgaagaagttgagggactggctgaagatcacgtacttactaagtagtacaactggagcaagatcaagtatctctgtctcccatatctgtgttctatcatttaaaatatatattggaaatccctgctgactcagattggtatgattaaaaatgagaggaaagttcaaatagttagtagtgacaaactaatactgctggactaagattttggtagcattgttttctaaaatattttaaatggagaatgaacacttataaaatgctttggaacataatctttagcttaattttctgttaaaatttagtaccccttcatcattccaataaagataagactgatccattgtctaaggaaattatttataaataatagagattaatttatttgagatttgaaataagaatagtatgaaaatattagataccacataaattgtttgaaattactgaataaccatcttaagtatggaacatttaaatggctatattttatttgtgtacagtttttctgtgccttgttaggccagtgaagcaattattttctctaagaaaatgacaataaaatataacacacttcagattgtctgatttacagtttggaaaggacaccgcaatgttcaaataggtaggagaccatcaaaaacacaattaaagtaacatattaggagacttgaaacttcagcctaataaatccttcatggttcttagccttattattgtgatataattctagatattttcttggagggcatgtgcccaactctcccgcaccccattttgtttgtcttttaaagttcttagaataaacagttctttatataataattatattttatttaagaaaatagtttgttaggtactttttaaaagatgtaaatttttaaatttacaaatacatatgggtctttgataagcaataggaattgaattacaagttactagggttataagcaaaaggttgcttaccataatgtcattaggtcacgatttttagctcacatctggaagcagcaactacttggctcaagtacatataagagtaattagttttattctctcttttttataaaatcgggtttcagatgagatgtttatcttagactattttagggaaaaattttacatgtttgagatggtggagtaaaaagactgttaaacatttcttttaaaaaattatttttacattacaacaatatatttatgatgtgttcagatcaaaaatttaacttctgtgtcccagatctactttcaaagtgagattttcacttgtcagcttaaatttctgactagaactaacatttgtgtatttttgtgcttagtcggaatacaaatttcacagtggatttttgaagtttgtccttaaattggataaaatcaagtgattaaagttactaaagagataaaaatggtaatttccatttttaaaagtaatttggttgtgtttatagttatttgtacaagtatttatcacagactctaaattgaaaaatgtagtatgatctatatttgaccctaaaaatgttggattaatttaacaaatatggcagatttttcataactaagtcttaagtcttctaaaaggaagctgttacccttctgtttttaattacattaattgaaatgtgttttaagagatacaatttcagcatattttatatattaaaaaacaaaaaaggattagtattgagccagtggccaaaaggtaatattactaccatgtagactgttatagttcaaattgtcccacttcacccagaattttagaaactagaagtctgggaggtactatatcagctgtagttgggtaattccaagtgctgatagtactattcatcttttttattattgtgtcagatgaaacaaatgccaagttgcaaaatatgcagatttttattatataatggttttaggcataaattattaacaagccatgccttatgtgtttcatcttatatttttctttagaactaaactataacagattttggaaaatgatttgacgtgcttgctcacttgattgacttggtcagatatttgaatgatggtattacctagattctaatccttgattctagttatataataaataatatagaatatgaaaatatgtttgggcatttactgtttatattatgtagtagcctccatcatgacacacttactacatttatgaattgagcagttctgtaattgtaattattattgctgttcatgtaacaaaacatgcttataatagcaaacaaatagaaatgcccccaaaatgctatttttttaattcagttataactgttactcttgtagttgtgtatgacgcaataaaatttgtaaaaaaatttcagcatgaaaaataaaatttgtatcacttatgtattttggctatgcttttgaaatttccttaacataaacaaatcagtgtagatattcaaaatcttttacctttaatccttttcatccttatagtccttacctgaactctactttagcattatctttgatttctttttttcattcacttaacttccaatcagtactcaagctttatccattctacctctgtaatgtctctggaatttatctcatacgtgaaatttcccttgatattatagacataccttggatatattgcaggtttggttccacaccatatcgataaagtgatataatcaagcaagttacacacctttttttggtttcccagtgcatatgaaagttatgtttacatcatactgtagtctattaagtgtgcaatagcattatgtcgaaaaacacaatatatatgccttaataaaaaataggctgtgtgcagtggctcacacctgtaatcccagcactttcggaggccaaggtgggaggatcacctgagcccagaagttcaagaccaaattggtcaacatggcgagaccccatataaaatatatacatacacacacacacacacacacacacacacacacacacacactattgctaaaaaatgttaacgatcatctgaatgttcagaagtttatactccttttgccggcacaggatcttgtctggatgttgtttgctgatagatccatgtagtggttactaaagttggggtggctatggcaatttcttaagacaacaatgaagtttatcacatctattgccttgtcctttcatgaaagatgtctctagcatgtgatgctgttttgatagcattttaccaatggtaggtcttttttcaaaattggagccagtcctctcaaaccctgcctctgctttatcgaccatgtttaaataattttctaaattctttattgtcatttcagcagtggtctcagcatcttcaccaggagtagattccaactcaagaaaccactttcttagctcattcataagaaacaattcctcatctgttcaagttttggcatcaagttgtagcaattcagtcacatctacagactccattgctaaattttagttctcttgctatttccacatctgctgtgacttccttcactgaagtcatgaacccctcaaaattatccatgagagttgaaatcaatttctttcaaactcctgttaatgttcatatttagacctcttcccctgaatcacaaatgttgttaatggcatctagaatggcaaatcctttctggaaggtttcaatttactttgcccagatccatcagaggaatcactacctatgacagctatggtcttacaaaatgtatttcttatatagtaagattcaaaagtcaaatttactccctgatccatggctgcagaatgcacgttgtgttaagaggcatgaaaacaacattaatctatttgtacatcatcagagctgttgggtgaccaggtacattgtcaatgagtagtaatactttgaaaggaatttttttttccaagcaggtctcaacaatgggcttaaaatattcagtgaaccgtgttgtaaacagatgtcatattatccagactgttccatttattgaacacaggcagagtaggtaaaagttttaagggtcctaggattttcaggatggcaaatgagcattggcttcaacttaaagtcaccagctacattcaccactaaagagagtcagcctgtcctttaaagctttaaaggcaagcattgacttctctttagctatgaaagttttagatggcacctttttgtaaaagaaggttgttttatctacattgaaaatatattgttcattgtaaccactttcatcaatgatcttagctagatattctgggtaacttactgcaggttctccatcagcacttactgcttcaccttgcacttttatattatggaaacaacttatctccttaaacatcattaaccaacctcttggtagcttccaacttttcttcaatagcttcctcatctctctcagccttcatagaattgaagcgtgttagggctttgttcaggattaggctttcacttaaggcaatgttgtggctggtttgatctattgaaaccactaaaacattcccatatcggcaataaggctgtttgattttcttatcattcatgttttctggaacacttttcaattacttacagtaaggaaatagcacttttaatttccttcaagaacttttcctttgccttcacaacttgtgcaagagacctagctttcagcctatcttgactttccaagattgtccttggtgagaaatgcttgattactaggtgtaattatttctagcttttgattgaaagtgagagatatgtgactcttccttttacttgaacagttagaggctattgtaggattattaattggcctaatttcaatgttattttgtctcaaggagagagggatgtgggaacagctggttaggagagcagtccgaacacacacttttttttattactttcactgccttacatgggtatggttcatgctgcctccaaatacttacaaaaacatcaaagatcactgattacagatcattaaaataggtttaataataatggaaacatttgaaatattgcaaaaattaccaaaatgcgacagagacatgaaatgagaacatgctgttgaaaaaaatggcactcatagacttgttggacacaggattgaaagaaaccaattcatcaaaaccacaatatctgcaaaacgcaataaggtgatgcacaataaaaggaagtatatctgcacttccttcttttttactgaaaaagcccaagttcttactctggtgttgagaacctttcattagctggctacaatctcagttcacaatcatttcttattgcccttcaacaatgtcctgaccaaatcgagttctttctcattgggaacagttcattcctttatcccttcgctcattctgttccttttttcttagaaaaattatttgcccatgttttttatcccccaattctatctttttcaatgcccacttcgtgtccaacccctctctactttccctctaaacttactcaaacacttggtgaactttttctgaatgttttttctgaatgtttacttttaaaggagttgcccagtcacaaagtttgagccaagtttttttgttttaaacttgttttaaacttttgttttcatcaacttttttcaaacaatttttgtcagcttagaggttgtgttttaattactatttttaaaatcttgtatgaggtagtatgatttgaaattagatggaatgtgcccaaaattatctctgtagaataatatggaaaaacgaaaatgaaaagatgtattacctgaatgtgctcctcctagccagtttctcaagggagaagaatcattaataagtttgtgaggctttttttttttttctggtagatttctgtttccttgatcagtggtttttcagaattttttaaagcttgtgaaatacttatttgtaaatagcatcttatgaggaaccttgatatgtgacaaaacagatgctttgatttgagagcagaagacctgcagcccctgactgctcacctttccagggacccctgaacattggcctagagggtagtgtacagtcacttcttcagtgataacttactgagtgtgattcaacaaaactgctttggtttatgggtgaaacataatttataactaggcaaatgtcagcttaaatttatattttctaaatagcactgaaaatgacaatagacaaatgtaatttctgatttttaagaaatgattttccattttaacatacattttaaatgttttgtcttcaaagggaatccttaaaaatgatatattggaaaccactgatttcttattttcatttcatgaatttcagattcatgaatggaatatattgataatagcattttttaagttgccccaaaaagatgaaatacaaataattttaatcccaaatctatttcagacacctaactttttttttattttttatactttaagttctaggatacatgtgcagaacgtgcaggtttgttacataggtatacacgtgccatgttggtttgctgcacccatcaacccgtcatctacattagatatttctactaatgctatccctcccctagccccctaccccacaaaaggccccagtgtgtgatgttcccctccctgtgtccatctgttctcattgttcaactcccacttatgagtggcaacatgtgctgtttggttttctgttcctgtgtgtgtttgctgagaatgatggtttccagcttcatccatatccctgaaaaggacatgaactcatccttttttatggctgcatagtattccatggtgtatatatgccacattttctttatccagtctatcattgatggacatttgggttggttccaagtctttactattgtgaacagtgctgcaataaacatatgtgtgtatgtgtctttacagtaaaatgatttataatcttttgggtatacacccagtaatgggattgctgggtcaaatggtatttctggttctagatccttgaggaatcaccacactgtcttccacaatggttgcaatttacactcccaccaacagtgtgtaaaagcttcctatttctctacattctctccagcatctgttgtttcctgacttaatgattgccattctaactggcgtgagatggtttctcactgtggttttgatttgcatttctgtaatgacccgtgatgatgagctttttttcatgtttgttggctgcataaatgtcttcttttgagaagtgtaaggtacttaattcttaaattaaaaaaaaatacccggccgggcacggtggctcacgcctgtaatcccagcactttgggaggccgaggcgggtggatcatgaggtcaagagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggggcttgcagcgagccgagattgcgccactgcagtccgcagtccggcctgggcgacagagcgagactccgtctcaaaaaaaaaaaaaaaaaaaaaaaaaaaatacccttctttaacaaaatcaagtttcaagttttctgccttgttgataacttgttaacatttttttattttagaataaatctaaacagagaccacactgatatctgtaacaacctatgtaaagttaagattaaggttaaatcacatttttcacagagagtgttttactgaaatataaacttttatgcatctgatattatctaattgtgtccttactgggtaacttgtgtatttttcaagttaaaggatttcctaaaaatgcttatttgaatatttatgtcatttgtcacacatactttcaaaacataaccttcttcaacgagtatcttcttttccttcctaaaatactgttaatagctggctattttgtaagcctgtatctggtttaaaaaaaagaagtgaatattttcaatacttatgaaccatagaattctgtattcttttcataacttttaacttttccataggacctatcactatgtaaaatattatacatatctactgatttatttattgcctatgtacctatactagaacatagtaaacatgagaacagggaatcttggttattaattcctgcaggactcaactacttatcactcaaacatttgttcttgaaaagaacttcgtataacatcattagatttttacagaatctttaaaaaagctttaatattttcaaggttttttatttatataaatattgttactttaccactagtgatttcaatagtggcattgtcacatgattcaagaagaggaggccattacattactgttgtattaaaaagtcagttcaggcttaatatatatgactactataagtcaacctcacattttaatgtatgaagaagattgtatgaacgatcacattaattcatttaaatagtatgtattttgatactaatttttaagaagaaatgtatcattctcatggaaataaaagataatttgaaaagca

SEQ ID NO: 193429 - DNA, 2126 bp, Homo sapiens
  Payload ID: 18189
  Gene Name: transmembrane protein 106B
  Uniprot ID: Q9NUM4
  ENST ID: ENST00000396668
  CDS Start-End: 188-1012
agcagcgcttggcctctgctgatgccgtcgttatcctacccctcccccgtcccagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtatgatttctgtactctgatatccatcaaagtgcataacatagtactcatgatgcaagttactgtgacaacaacatactttggccactctgaacagatatcccaggagaggtatcagtatgtcgactgtggaagaaacacaacttatcagttggggcagtctgaatatttaaatgtacttcagccacaacagtaaaaactggaagagatggatttaaagaagaaatatctattgatatttcctatactctcaatgaagaggtatttcctaataggagaccttaaattgaacaaacctaaagtttacacttctaagagtacagttaaaagtatgtggacctgcagttcttgtaactctccactctgtgttaatgatatatttgtactaggatcttttacttgaatctaaatttactggttgatttccttctccagcctatcccctacagggaaaagctgatacttcccctatagtacaataaataattatttaaaagtcatagctccagtcactactgaaaacataattttggtgataaacataatttgagaaacttaatttctgaatgtttttatagaaaattactgaaagtctattactcatggaagacttttaaagaataaccttttttcctgttttataaattcccattgttatatggtagtatttcagctacacaatattttagcttttagctagacatttatagcttttcatttgttgaaatggtaatcatctgcatgtttttgtcacttatttcaggttagtgattgcctaacacttataagccaaaataatctttgcaaaattccatacctaaaattttgaaagcccctaatgttttcacacatctttctgtattagttatagttttgtgaaatctttgtgtgatcttcaaacattatcatttaatgtacaatactgtaaataaactgtgcatggcttttatacagctttagtaaatgtcaaataaagtggtacagactcattacaacaagtttctcataaaaatacaataaataggaaaatgaaattcagaaacccatagactgggaataggttccagttacagcttggatctggcataaaataaatttgaaataaaatattttgatgctccatttttttatgttgcttttcatactaaagaatggtgtagacatgttttgcaactgttaggtacccagttatcaattttatcaatgttttagaggaggaaattatttttttggtagaaattgttcaagaaatccttaattgaatgtcattaaatgatggtggccaaaataaaacctatttagaaatttaa

SEQ ID NO: 193430 - DNA, 1492 bp, Homo sapiens
  Payload ID: 18189
  Gene Name: transmembrane protein 106B
  ENST ID: ENST00000420833
  CDS Start-End: 159-473
gttatcctacccctcccccgtcccagctctacggcggccgcgcgctccaggccggtcgctccaccccccggctcccgggactgtggactccacgaccctgtcctcggccctgtccgcgccgaagcagcccgggactgcgcagcgccccgcgtgccgacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctaggggatggagtttccccatgtttcccaggatgatgtcgaattcttgggctcaagcgatcatccagccttggcctcccaaagtgttagaattacagctgtgagccaccacgcctggccaacctaatatttttaattcattatctaaagaagaagaataagctggctgtgccctaatgagttaaagaaactctgtgaagagggatgggcaagaaaaccaactggtggcattgattccatatagtgatcagagattaaggccaagaagaacaaagctgtatgtgatggcttctgtgtttgtctgtctactcctttctggattggctgtgtttttccttttccctcgctctatcgacgtgaaatacattggtgtaaaatcagcctatgtcagttatgatgttcagaagcgtacaatttatttaaatatcacaaacacactaaatataacaaacaataactattactctgtcgaagttgaaaacatcactgcccaagttcaattttcaaaaacagttattggaaaggcacgcttaaacaacataaccattattggtccacttgatatgaaacaaattgattacacagtacctaccgttatagcagaggaaatgagttatatgtagtaagttctgatttataataactttttattgtcaaataatgaagtgtataaaataaagtataaagagtatacatattttttaatttccgttatcagtcaaaaagagtacattatgtagtattctggcttctggtcctctctgttcctctttttcaacatatataatattcatgtatatatacacataaaatttgtttttttatttatttttcagaattagggttataccatgtcactttatttttcattactatgttactgtgttaaacttgttactatgttaaaataattataaattttcatcatcttttgaataagcgtagatacagacttttagggtaaataacaacctagttatcaaaatttcagaagatgagcaaaatatataagtaatttatagcctgcatttaaacaaccctgcaactgcagtggcatgaatacatacatgtttttcgagtaagaagtcatgaatatatcagtcattgtttgaagtatagaaaa

SEQ ID NO: 193431 - DNA, 496 bp, Homo sapiens
  Payload ID: 18189
  Gene Name: transmembrane protein 106B
  ENST ID: ENST00000442107
  CDS Start-End: 422-496
ggtcgctccaccccccggctcccgggactgtggactccacgaccctgtcctcggccctgtccgcgccgaagcagcccgggactgcgcagcgccccgcgtgccggtgagcgaccccggacgtgcagtccccaggtccccttccggagcgaggctgagcggctgcgccgcggcttgagccgggcctgacaaggaggggaggccgctggggtgctgggccagccgcagatcttttcctaattcagcagcgatttaaccaagagcctggaatattttaaggagtaataagagacatttacaaactattctctctgaagcctgctacctggaggcatcatctagataatcagaaccttggcttccacatcctcctcccttgtcttaactacaaacatttctttctgctgacttcaactcctcagacatgggaaagtctctttctcatttgcctttgcattcaagcaaagaagatgcttatgatggagtcacatctgaaaac

SEQ ID NO: 193432 - DNA, 584 bp, Homo sapiens
  Payload ID: 18189
  Gene Name: transmembrane protein 106B
  ENST ID: ENST00000444443
  CDS Start-End: 255-584
ctctacggcggccgcgcgctccaggccggtcgctccaccccccggctcccgggactgtggactccacgaccctgtcctcggccctgtccgcgccgaagcagcccgggactgcgcagcgccccgcgtgccggtgagcgaccccggacgtgcagtccccaggtccccttccggagcgaggctgagcggctgcgccgcggcttgagccgggcctgacaaggaggggaggccgctggggtgctgggccagccgcagacatgggaaagtctctttctcatttgcctttgcattcaagcaaagaagatgcttatgatggagtcacatctgaaaacatgaggaatggactggttaatagtgaagtccataatgaagatggaagaaatggagatgtctctcagtttccatatgtggaatttacaggaagagatagtgtcacctgccctacttgtcagggaacaggaagaattcctagggggcaagaaaaccaactggtggcattgattccatatagtgatcagagattaaggccaagaagaacaaagctgtatgtgatggcttctgtgtttgtctgtctactcctttctgga

SEQ ID NO: 193433 - DNA, 1394 bp, Homo sapiens
  Payload ID: 18190
  Gene Name: transmembrane protein 106C
  Uniprot ID: Q9BVX2
  ENST ID: ENST00000256686
  CDS Start-End: 79-774
tttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttg

SEQ ID NO: 193434 - DNA, 1515 bp, Homo sapiens
  Payload ID: 18190
  Gene Name: transmembrane protein 106C
  Uniprot ID: Q9BVX2
  ENST ID: ENST00000429772
  CDS Start-End: 114-866
gaccgaagaggctggtaagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttgatagaaaaataaaccctgcttttgattca

SEQ ID NO: 193435 - DNA, 1414 bp, Homo sapiens
  Payload ID: 18190
  Gene Name: transmembrane protein 106C
  Uniprot ID: Q9BVX2
  ENST ID: ENST00000449758
  CDS Start-End: 99-794
taagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttg

SEQ ID NO: 193436 - DNA, 579 bp, Homo sapiens
  Payload ID: 18190
  Gene Name: transmembrane protein 106C
  ENST ID: ENST00000546749
  CDS Start-End: 392-579
gtgccgctccgccgaccgaagaggctggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttccta

SEQ ID NO: 193437 - DNA, 810 bp, Homo sapiens
  Payload ID: 18190
  Gene Name: transmembrane protein 106C
  Uniprot ID: Q9BVX2
  ENST ID: ENST00000552561
  CDS Start-End: 58-810
gcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaa

SEQ ID NO: 193438 - DNA, 581 bp, Homo sapiens
  Payload ID: 18190
  Gene Name: transmembrane protein 106C
  ENST ID: ENST00000548640
  CDS Start-End: 141-581
ttgttgctcgaggaggggcatagagcttacaaatagtgaagaggaaggggcgaggctggaccaggtgggagcgggggtgccccaagtcccagggcggtgaggatcgaggcaggacatgacaccagtggcatatcacggccatggggtctcagcattccgctgctgctcgcccctcctcctgcaggcgaaagcaagaagatgacagggacggtttgctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagaca

SEQ ID NO: 193439 - DNA, 321 bp, Homo sapiens
  Payload ID: 18190
  Gene Name: transmembrane protein 106C
  ENST ID: ENST00000549288
  CDS Start-End: 67-264
gcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagaacttcagtgaagatttcatacattggcctcatgacccagagctccttggagacacatcactatgtgg

SEQ ID NO: 193440 - DNA, 663 bp, Homo sapiens
  Payload ID: 18190
  Gene Name: transmembrane protein 106C
  ENST ID: ENST00000550146
  CDS Start-End: 94-354
ctggcgggcttggtatttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaacgccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgta

SEQ ID NO: 193441 - DNA, 491 bp, Homo sapiens
  Payload ID: 18190
  Gene Name: transmembrane protein 106C
  ENST ID: ENST00000547682
  CDS Start-End: 1-352
tgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaa

SEQ ID NO: 193442 - DNA, 742 bp, Homo sapiens
  Payload ID: 18190
  Gene Name: transmembrane protein 106C
  ENST ID: ENST00000552546
  CDS Start-End: 56-595
gtgccgctccgccgaccgaagaggctggacatgacaccagtggcatatcacggccatggggtctcagcattccgctgctgctcgcccctcctcctgcaggcgaaagcaagaagatgacagggacggtttgctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccactt

SEQ ID NO: 193443 - DNA, 326 bp, Homo sapiens
  Payload ID: 18190
  Gene Name: transmembrane protein 106C
  ENST ID: ENST00000548965
  CDS Start-End: 1-326
ggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaacaacttcagtgaagatttcatacattggcctcatgacccagagctccttggagacacatcactatgtggattgtggagga

SEQ ID NO: 193444 - DNA, 583 bp, Homo sapiens
  Payload ID: 18190
  Gene Name: transmembrane protein 106C
  ENST ID: ENST00000548355
  CDS Start-End: 25-279
tgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaacgtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaa

SEQ ID NO: 193445 - DNA, 660 bp, Homo sapiens
  Payload ID: 18190
  Gene Name: transmembrane protein 106C
  ENST ID: ENST00000553217
  CDS Start-End: 29-241
gacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacaggtgatcatggagggatgattccctgatgagaatcccaaggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtg

SEQ ID NO: 193446 - DNA, 776 bp, Homo sapiens
  Payload ID: 18190
  Gene Name: transmembrane protein 106C
  Uniprot ID: Q9BVX2
  ENST ID: ENST00000550552
  CDS Start-End: 54-749
gccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagc

SEQ ID NO: 193447 - DNA, 685 bp, Homo sapiens
  Payload ID: 18190
  Gene Name: transmembrane protein 106C
  ENST ID: ENST00000615597
  CDS Start-End: 1-226
taagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtagtaaggacactgttctctctgtgtgtgctctctactggaggaaagggattcaaagtcatactccattgattggggcctggtcctgccttagatctcagcttttgacttataggttccctggctttggatgtcttgagatttatttgaagaatgtattattattatgtgtgtatttgaagaatgtattatttgatatgtgacagaagtgctggaatttctaaaagagaacattaagccactaaaaacgttaccaagctccagcacttatgtgatgggtttgaaaaaacagaaagtggtatgacgctgtgggaggatgaaaatgacagtggcagggactgagagctgacaagccttggcagcacttaggtcggaagggggaggggggcaccccaaacaggacagtgtaactctgcactcttctactgaggctttaaaaaaaaaaaaactgactatttccata

SEQ ID NO: 193448 - DNA, 976 bp, Homo sapiens
  Payload ID: 18190
  Gene Name: transmembrane protein 106C
  ENST ID: ENST00000550161
  CDS Start-End: 99-644
taagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtagtaaggacactgttctctctgtgtgtgctctctactggaggaaagggattcaaagtcatactccattgattggggcctggtcctgccttagatctcagcttttgacttataggttccctggctttggatgtcttgagatttatttgaagaatgtattattattatgtgtgtatttgaagaatgtattatttgatatgtgacagaagtgctggaatttctaaaagagaacattaagccactaaaaacgttaccaagctccagcacttatgtgatgggtttgaaaaaacagaaagtggtatgacgctgtgggaggatgaaaatgacagtggcagg

SEQ ID NO: 193449 - DNA, 756 bp, Homo sapiens
  Payload ID: 18191
  Gene Name: transmembrane protein 107
  Uniprot ID: Q6UX40
  ENST ID: ENST00000316425
  CDS Start-End: 114-554
gagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaa

SEQ ID NO: 193450 - DNA, 455 bp, Homo sapiens
  Payload ID: 18191
  Gene Name: transmembrane protein 107
  ENST ID: ENST00000431792
  CDS Start-End: 31-255
cagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagt

SEQ ID NO: 193451 - DNA, 747 bp, Homo sapiens
  Payload ID: 18191
  Gene Name: transmembrane protein 107
  Uniprot ID: Q6UX40
  ENST ID: ENST00000437139
  CDS Start-End: 89-511
ctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaatt

SEQ ID NO: 193452 - DNA, 1210 bp, Homo sapiens
  Payload ID: 18191
  Gene Name: transmembrane protein 107
  ENST ID: ENST00000449985
  CDS Start-End: 88-195
tagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccggtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaa

SEQ ID NO: 193453 - DNA, 2358 bp, Homo sapiens
  Payload ID: 18191
  Gene Name: transmembrane protein 107
  ENST ID: ENST00000532998
  CDS Start-End: 88-411
tagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctgtatcctttctgcctgcccacctttcccacacgacccacttctatcaggactcccttcagccacctgacacaatagtgtctgctgtagccaatccttccagttcaaagatcttcaacgatgtgctaaatcctgctgtttactaggcacttaaaatcccaaaatgagagtaaaatacagtttttggccaggcatgttggctcacgtctgtaatcccagcactgtgggaggcgcaggcaggaggcaacatagtgagaacccaagtctacaaaaataataggaataataaaaaccccaccgtttctttttacaatgaggaggaggtagatacaaatctgtaattcagtgtgataagcactgtgctatagaagtgtgtgaagatagaaagcacaggcagggcgcgatggctcacgcatgtaatcccagcactttgggaggccgaggcaggtggaccacctgaggtcaggagttcgagaccggcctgaccaacatggtgaaacccccgtctctactaaaaatacaaaaattagtcgggcgtggcggcgcactcctgtaatcccagctactcaggagactgaggaaggagaattgcttgaacccgggaggcagaggttgcagtgagctgagatcgtgccactgcactccagccagggcaacagagcaagactctgtcaaaaaacaaacaaaagatataaagcacaatgggaactcagaagaggcaacggaagcgagcactgggaactcagaagaggcaaaggagatgaggcacatgggtcagagaattgtggaccaggaggaccaggacactggaggctgattccagcgcatattaagtcgctgtcagcactcctttgtggcatagcagaaggagagcctactcttacctctcatctgaaggatccaggctggcccacagataaggggtagggtagcctgaggtccgatctgtgcagtcacttctggtctctcctcacatgactgtcctaaaattcagaagtcagagctgctgactctagcccttgaaacatggtgagggagcaagggatgaacctgaatgcagatgccagccccaccactggccttttctgacccatcactgtctgtcgatccaaagactttccttaatctcgtgccttcccaagccattggggctcactgtagtgcatccgtggccctgtccttcttcatattcgagcgttgggagtgcactacgtattggtacatttttgtcttctgcaggtgtggtagcatccaatatttggggatgagggaggaaggttggccctaaacctgaaggtttttcccctacccagccctttcctccatgtgtgagataccagatccactcaacatcctgtaggcttttaaagtttcatcccctaccccccatgccacctgccctacactttcagaggtggggtctctggtttggagatttgggtatttatactgaaagggtttctgaatctaccacttgccttggtagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatg

SEQ ID NO: 193454 - DNA, 726 bp, Homo sapiens
  Payload ID: 18191
  Gene Name: transmembrane protein 107
  Uniprot ID: Q6UX40
  ENST ID: ENST00000533070
  CDS Start-End: 103-522
aaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattgtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaaca

SEQ ID NO: 193455 - DNA, 3744 bp, Homo sapiens
  Payload ID: 18192
  Gene Name: transmembrane protein 108
  Uniprot ID: Q6UXF1
  ENST ID: ENST00000321871
  CDS Start-End: 211-1938
gctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagaggattctgttgctaatacat

SEQ ID NO: 193456 - DNA, 2165 bp, Homo sapiens
  Payload ID: 18192
  Gene Name: transmembrane protein 108
  Uniprot ID: Q6UXF1
  ENST ID: ENST00000393130
  CDS Start-End: 196-1923
agccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgat

SEQ ID NO: 193457 - DNA, 555 bp, Homo sapiens
  Payload ID: 18192
  Gene Name: transmembrane protein 108
  ENST ID: ENST00000510183
  CDS Start-End: 96-555
ggtgaggcggccagcttcatgaggaaggagaatgcattgggaagcaagaaaagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgcccca

SEQ ID NO: 193458 - DNA, 823 bp, Homo sapiens
  Payload ID: 18192
  Gene Name: transmembrane protein 108
  ENST ID: ENST00000514894
  CDS Start-End: 556-823
cggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaaggccctgccttctccatcagacacctgggaatcacagctggggcccctgctttggccgtttgtcctgctggaatctgatggaggaaagacgctctgagagagtaattagacgcagacagagatctctctccatagtcagaggagcctagcaggggctgaaggaactgcctgaggatgacaaagaaggggatccatgaacaaggaggtgctaacaggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgccc

SEQ ID NO: 193459 - DNA, 510 bp, Homo sapiens
  Payload ID: 18192
  Gene Name: transmembrane protein 108
  ENST ID: ENST00000511555
  CDS Start-End: 296-510
gtatgcaaagacagagcctctcatgagaacttggatggtggagtataaacactcatttaaaaataaatccagatgtagttggctgcagtcatctgacagaaccctgattctctcttcaataatgacgttcatttgtacctcattaattgagagtttttaataatttctccagggtaagaaaactgagtcacacaaggatatatttgtgtaacacaatttcaaaaaggcaaactcttgctcttgttaacgacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatgg

SEQ ID NO: 193460 - DNA, 4833 bp, Homo sapiens
  Payload ID: 18192
  Gene Name: transmembrane protein 108
  ENST ID: ENST00000515826
  CDS Start-End: 124-1590
tccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctcagatcctatcacctgaaagcatgcccttccacaaatgtgaatacagtactcagggctccatctgaaaatggagtgacccctcttcttcctgtcacacatctgacaagccatggatgactccccagtgacattcctgggaacccaagagagcttaattcccaactctgttttaaaactcaaggaaattgggactccatgacctcctccagagtcttgatggctactgcctcaggagaaacagagcagttgaagcttttcaactaaatgggaaagggaacagttaacatcttgtgtttgcatagagctgcgcagtttacaaaacgcttctgcatatgtcatctctataccctccggtgttcaggacaatacaggatagtggatatcaacttgaagatcatcaagacctggactcaagttgcagtaattagttgggtgatcaagatcaatactattagcttctatgaccttcagttacctgttctgaaaatgggaagagcaatagtgccttcctcaggcagttatcatgtgggctaaataagcttcaaagtgcctgggtcagtgctgggaatatagtagagaccctgtaagtctgacttgtacttttctttcttggatgaaaggtgagaccactgaaatagtgaatgttctaacccctaggtggagctttgtccttgagccacccaatagtcatataacacagtttttctttctagatctctcttgtagaggatgttgggagaacaagaagagaactgtcattaattaagcatccattgtgtgtcaggcattgtgtttggcattttgcatccatgatctctttaattctcattacaagcctatgaagttcatcttaagtgactttccaggtggaatacatggcagagtcacaatttgaacctaggtctttctgtagccaggctggctttcagtaagtaaatgaaatggtgtttgagaagcactggaaactccctgagagaaatataatcaggccaggagcatgaacatgtgaggggaagacagcgtggagcagaactttctgttctgactcccaggccttcccgcagggcaggatctctgcatctggcattctaacaacatgggctgttagagcactggactcgggggcggaggacttggattctgcaacctctaccagcccaggttagcagcatggccttgagcaagttcacctctctaggtttccatgccccaccttctagaataagaatgtaggctgggggaaggggctgatttgtttcagcacctactgtgcaccagggacaatttgaagtgctggcagatgtatgactgcatttaatcttcccaaggaagctgacgctgagagaggttaagtaacttactcaagtcatgcaagtaatagattgtcacctagattctaattctaaattcgatgtcccttttgccctattgactaggcctaagatggcatctgtcactttgattctgtttgcttataactgctcagtagatcagaggcacaaatatctttctaccttagagaggcgtgcaaactatacaaatctgactcacagatacacttttcccctgccagcctgtgttctgtgtctatggcagtgttttgtggggcatgatgggatgtgcccctacaggctgataactgaagagctgttctgtttgtcctgattgctcccctccctctagctctaactctaccaaaactgagctggagctgaggaaacagcacttttcccacttcccagatggttccctctttatggcttctgtcacaccagctagaactcctccaggtgtttcaccatgccagctgcaggagcagagtgaaaggtagtgacaatgaagaacagagacaccagagaaggggacaggggacccgggatcttgtcccagctctgccactcacatacctgtgacctgtggcaaggcggccagcactttaggccacagtttttcctctagaataaggaggcggcctgaattagcaagtttcaggctgagcaccacagccccctccttgcccctttcctcttcaaccatctgaagaaagggttttttggaaggaagggagggaaagaggaaagagatccacaatatttgaaaagttctgtaccagctaatctctcaaatccccgttagccctaacactcagaaattccttctatgttttaaagattttttaaaaaggatctagaagactgaaaagcaaattagaagtctttttgatcaaagcagataagataaagtagaaacttaccctatctcctaaccttgtacagagacctttccaggttgagaggccagcaaggctggcagctggaaagaaagctacagaattccccaggcagcctacagggccctgggctctgggctgtgaggtctcagcctatacaggtgccagcttgtgcaactgccccacaccctggcatgaacccacccctgatgctggccagaccctcaggctgctgcgaacagagctggccctctgccaacccccggtgctggcctctctggacagcccagcctgggaccccgactccccagcacagagatggttggcaccaccaggatgtcagatgtggctcttggcttcagctctcctcatccccagaggctctggtgatgatgaacctggggcaggatatactcagtcctcacttcatggcttctccccaagaggcctctgtcacccttgtccttgtgttacccttctgcagtgtgaatctggacaggccaccccacctctctgacctcagaagccttccctgctcacaagccactcaattcacacatggttaatcaacaatatcgagacataattcttcctcctgggccctgggagtctcagggatgaacagacagggtcacatgtcacactgtgctcagtcaagctgtgtggagcccacctcaggccatctgtgcaggtgggcttttgcatcaatctaaggcaggaatcagctggtaagagcatagactggccaggtgcagtggctcacacctgtaatcaatcccagcactttaggaggctgaggcaggcggattacctgaggtcaggagttcgagaccagcctaaccaacatggcaaaaccctgtctctactaaaaatacaaaaattagccagacatggtggcaggcacctgtaatatcccagcttcttgggaggctgaggcaggagaatcgcttgatcccaggaggcagaggttgcagtgagccaagattgcgccactgcactccagcctgggcaacggagctagactccatc

SEQ ID NO: 193461 - DNA, 2470 bp, Homo sapiens
  Payload ID: 18192
  Gene Name: transmembrane protein 108
  ENST ID: ENST00000508711
  CDS Start-End: 370-687
gagagcaagacggcagcatctacggttctttctgctcaggaatgggaacccagagtgggcagtagagcggaggcaagccatgcagaggcaggagcagatgagaccctagatgccacgagaagctaaacatgtggggaaaataaagagcagattaactcaggaaaattatatggggagctcttatgctactctgaagatctgagactcgttggagaatttacaatcccaaattaactcagggagaattccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaactgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagcc

SEQ ID NO: 193462 - DNA, 681 bp, Homo sapiens
  Payload ID: 18192
  Gene Name: transmembrane protein 108
  ENST ID: ENST00000512137
  CDS Start-End: 236-681
gaagctagtctacacacatggatgggactatggaaatatacatgtgacttttaaacctgaacagtagctgttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggc

SEQ ID NO: 193463 - DNA, 874 bp, Homo sapiens
  Payload ID: 18192
  Gene Name: transmembrane protein 108
  ENST ID: ENST00000512662
  CDS Start-End: 510-874
ccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggatgcttttcaacttatggtggtgtgacatcctgataaacacaatacagaatcatgaataaactggaggataagcaggaccagatgataccatgaagagaagtttacaggccctctattgccaactgttaaggttatctatgaagcacttgtgatgtttttgagcagtaaccaccattttttgagtatgtacatgttacacagcctgtcatataccaatcatgtcagtcaggatccccacagggagcagatggcactcaactggggtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctc

SEQ ID NO: 193464 - DNA, 2413 bp, Homo sapiens
  Payload ID: 18193
  Gene Name: transmembrane protein 109
  Uniprot ID: Q9BVC6
  ENST ID: ENST00000227525
  CDS Start-End: 404-1135
gtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaa

SEQ ID NO: 193465 - DNA, 1959 bp, Homo sapiens
  Payload ID: 18193
  Gene Name: transmembrane protein 109
  Uniprot ID: Q9BVC6
  ENST ID: ENST00000536171
  CDS Start-End: 17-748
cctggcagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgct

SEQ ID NO: 193466 - DNA, 2095 bp, Homo sapiens
  Payload ID: 18194
  Gene Name: transmembrane protein 11
  Uniprot ID: P17152
  ENST ID: ENST00000317635
  CDS Start-End: 473-1051
cgcggaggggcccggcgctagtagcccgcagacagcgcggcggcccccagcgggagaggcagcctggcggccaggacagcgcggccgggcgcctccgcgcagtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttcaactcccgctgttctctctttccatgactgcccgcagctgctgctgcacatctgctctgggtggcggcttgcacatggaaggagcaggtgccatggtagccaccctgccctgctcctagctgcggcccagtgttaccacttacagcgacgacaagcctagatccaaggtagtcctggggccaaaccccgcccaggagcagtctcctggctcaccttggcctcatcattccgaaggccatcactgccaccatgctgttcaggaacatggtaggataaggtgacgaggcttggaggcctttgggtgtccacttgagttcacgtggggaactctgggctccaggatcgctcttcagagatctgaacacctgtgttttctttgaagcaccaaaactcttcctactgtggaccatgagtttattaacccattgccctaggctgacagaagagccctcggagcaatcttggaagcaccccctggcctcagtgctcgctgttccacaggagccaagccggtgcttctccctcacaccagaaggtagactgtgtcacctgccacatttcctctaaggcaggggtggccaatcttgacttccctgtgccacattggaaaaagaattgtcttggaccacacataaaatacactaacgacagctgatgagctaaaaaaaaaaaaaaa

SEQ ID NO: 193467 - DNA, 4769 bp, Homo sapiens
  Payload ID: 18195
  Gene Name: transmembrane protein 110
  Uniprot ID: Q86TL2
  ENST ID: ENST00000355083
  CDS Start-End: 147-1031
cgggttacgcgcggcgcggagtcggcggccgggcggaggtaccggctcaggcttgggatcccggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccgtatgacacattcccatgctgggggtgacgggagggccccgccagccgctggtgtgcagaggtcatcccgcagcatcgttccttaccctctctctgcccttcctttctacctctgctcctcttgctgtctctgcccgctctcgcctgcccccagactactgtgacttaaaaagagggaagaggagccagcgcccgagggggccactggcggctggaggtccccattcagttgcactacaaacactgaccaaatatgcaaggaaggagctgtgtttgtttgttgtcgtcccagacagtgttgtgagggacctgaggccctgccccgtgtccgaccaccgagtggcaaggtggaaggaagcacaggcacacagaccgtgggtgggtctcctcaccgtggctgtgggcagtgcgaacacataacaccctcgggctaaaagtgactcgttgaccaagttggaaccggaatgctttcttactcaaaatggcttttgtaactattgatttctgaagctggttttatgagttgtgacagtgttaccaggttgggggtatgtgtttatttcctacaaagtacttacgggactaatgggcaaaacagagatttttaagtcttccgtatgctgtttgacttttatatttttaagttatattttcatactattgtatttaaaaactctttttagtccccaaagaaatgggtttatttgcctttcatggggtgtgggctggcaggaggaaaaatcgggagttttttatttggaatattattagatgatgccctatgataagatgagacaaatgatggggagggaaggaggatggcccttctctagaatcagcaaacccaatggttctgtgaaggtcagacccaagcttggagcagctggtctggatgcagatccaggagctgcagagtgtggaacaggaaaggctctgcccagggcccatgagctctagcattcctgctggcagattagagatcttagttaaatttgaccaagaaaggagcttagctaagaggtctttgtttccagaggacccaagactaccagactcctgtgcagtctgcctgtctgcagagcctccaatcacggtttaaagtggtcttggcctcccagcccccactgctgcagccttcagagccagcctctggactcagcgccaggagcctcctctcctgctgccctggtacctgtcatcctagtgtcacctatttgttttgcacagcattctggagaacatgtgcctcacaaagtgatcctgtttttctcaccctccaaagctgaggtggctaagggaggcaggggtgagagagctcactctctaaaccacaggcagggcaaggtgcttctaggccgtgtcccctccctggggaatggtcactactcctcagcatggccacaggcccctgtggttttgggagtttgctgagtgactgtggaatgggctgaccccagccgtttccctgctgtggaaacagcaaggtaggggcactgcttggtggtttgtcaagctcagaggcagccacggatggttaggaacaggaagccacactgctaaggtgtgatgagctagaagggagacatcctggacttcaagtgagacaagtgcagaggaggccactccacttaggaccttccttttagacctgcatgagcacgtgtttcacttaagcacattgggtccgaattgggcgcatgaacccagctgttaaaccaggtaccctgggactgccctctgcctctcagagccctacctgtcctggacttgaaggcgagcatcaggcaggccttctcagcccatcttccaccaggagtgcagagccagggtgctgagaggagcagggactgtaactacagtaggaggcaactttgctggtgtcattcctgctcggattgactttgtgctccctcccatccacagctatggtagccagtatttccccagcagctctctagtggggaagagtggctagaaccaggccattctcagtcgaatttaggaagaccaagactcatgttcctgacaggacggtcattccctcatggcatcactgactcagttctaattcctcccctcctgtttcattttggtttgaacaacctgtgcctgcagctgtttcttccaccttcctggagctcacaattggagcttcatgttcagtcttgagctcctaatgtttccagacagggcaggggataggagagccataatctatgaaagctgtgaaacaaaccctgggttatatagatctcagatggtctcatctgaaggctttgcccacttcccagtgagcagagggtttggggaacaaagaggtagctgaagagtggtggtttttccctgtatcctgattttcagaaagggctttagtctctgagctgtggctagtagctggctggctgaccaggggacgggggtctaatagggtgtctgaccataggacacctctcgtgtttggccttccctttcttgtgtgtttgtgtgtgtgtgtgcacgtgcacgtgcacacacatgtacacacacaaatctgtatccccaggagtgcctcctgcagtcactgggggctcttccgtggtgcaccatcccatgagagcagatcagagggctgtggtcaggacttcctcccgagctgccctccctccctgggatgagtttcctctccacctgctccaaggtgccttacgaggtgcagctcttcacctggccacatggcatccatcaccgtgttgagaaatggtgggacgttggctggatattgtgtgctatgaatctgatttgtccaaatctggacctcagccaagccacctgtggtggaaccttgcaagtcaaggtcatgaacaaatttcttgtaactattggaaataaactaatgaggtagaactgtcatatccaaatggaagaggtggttggtactgttacttccttttgctgtcagagggttgttgacaatggcaaggggggatgttagtgagatccaggtggtggtggcttcttggtccactcagcttgcacacatgcaagaggagggtctgtggcccctcagccgtgctggtggcctccttcctcaagctttaacttgtgccctccctggcaacagggagtcatgggttaatgtcacctgtcatgcctctttcttcagggaaaatattaaaaggctcaaatccaagctgtgacttcccttagacagtgtaagcctgtagggtgcagccccaagtttatgtccaaaggctgcctcagaaccctggagggagcagcgcccagctggcagctcactctgcccttgcagttcactggccttttcgcagccaggctaagataggcagtgcaaggagcttcccactggccagagcagctgccttgtagaatgtggggctggcttttagaagtttcacacgcttgcagctaagagtgcagagctctctgttttacttcgtgaaacattagcagctctgaggggcttggcttttggtaagggacttatggtctgacttgccacaagcaccttgagctcctgggttggttggtggttggttggttgggttgttttaaatttgatttttcttttcctgaagtttgttagaagtcagacctatgcaaggaaaaccatggcccacttcagcagccatccagtgggggtgcttaatcggtggtggtaggattcatggaaacgtttttttgaaatgaaagagaagatgatgtacttacattgtaaaatggtttacaataaagtttggcatctta

SEQ ID NO: 193468 - DNA, 514 bp, Homo sapiens
  Payload ID: 18195
  Gene Name: transmembrane protein 110
  ENST ID: ENST00000485356
  CDS Start-End: 1-269
ggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatgaagagaaggccaagagtttgctgatgagaatgcgggactcagggaaataagccacacagccccggcggttgagaccagatccaggtgacgcatggtgtctgcactctgattaccaggccactctttcccatgtggaagccctgacatctgggtcacggtgcttcatgggtcttgctgcccatccctggccaaactctcccttttgaaagcctctcgccacagatgtgttccctccttttggcccctattgctgtgacttctactgaggaaataattaaacccaaacaaaacaccc

SEQ ID NO: 193469 - DNA, 525 bp, Homo sapiens
  Payload ID: 18195
  Gene Name: transmembrane protein 110
  ENST ID: ENST00000482155
  CDS Start-End: 1-120
ctgatctcagcggatgatgagatggaggagtccgacgtggaggaggacctccgcagactgacccccctcaagcctgtgaagaaaaagaagcaccgctttgggctacccggaccagagtgagaaggaaccttacgaagcctcatggcaggagtgggagccagcaactgcccagtgaaaagccaaacatgctcttgccatgtccatctccacttcttcgctagtgagaattaaagcaagtccgtctctgaggaggacatcgtgttggggaggtagagtataagcagtgagtagcccacatccttgtccctgaggctgcggggctggaaggaggtccctgggcagagccgcagcatcaggtgccatctgcaggggcacccctggaactagtggaaggcccccacaaggcctggcctgccctcagctgcctcttggcccatgtgccacatcctgggcattcctcatgtcagcacttgtctcagatcaagcctggcagtcctctcattggcctcctggagccagggtgtc

SEQ ID NO: 193470 - DNA, 458 bp, Homo sapiens
  Payload ID: 18195
  Gene Name: transmembrane protein 110
  ENST ID: ENST00000467979
  CDS Start-End: 94-291
tgggatcccggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctaataatttgtgacaacttagccaaaatccgctgctgacttgggcgcatgtactgtacgtgtgtgttttcaagacatgtcaaacgcttcagagaaccaaagcatgaaagacgtccgtggaggatatggtttttagacacttccaaacaagccataggaatgctgttcatccactttgcaaatgtatacctagcagatctcactga

SEQ ID NO: 193471 - DNA, 899 bp, Homo sapiens
  Payload ID: 18196
  Gene Name: transmembrane protein 114
  ENST ID: ENST00000568335
  CDS Start-End: 198-626
gtgggttaaggtgctggtggggaaggactagagcttccaggagggtctgaaggcggaggtggaggtcggacagcacaagtgagagtgagggggtctgcaggtagagctggcattggaggggtgggaacgtggacggcggctgagcggggggcgcgtgcaggtcggagccggcagtgcagagcccgtgcacaccgctgatgaaccccttcaggctggagaacgtgacagtcagcgaatcgagccggcaacttctcaccatgcatgggacatttgtgattctgctgccgctcagcctgatcctgatggtttttggggggatgacggggtttctgagcttcctcctccaagcctacctcctcctcctgctcactggaattctcttcctctttggagccatggtgaccctcgctgggatcagcgtctacatagcgtattcagccgccgccttccgggaggcgctgtgtctcttggaggagaaggccctcctggaccaggtggacatcagcttcggctggtccctggccctgggctggatcagcttcatcgccgagctgctcaccggggcagccttcctggcagcagcccgcgagctcagcctgagacggaggcaggaccaggccatatgagcctgggcgctgggtcgtggaggggagggaggggcttggccccggagcttcaccgaccgatctccatcggctgcggcctcttcttcctcaaaggccactcggggaggccaggcacccccctccttcccccacaaatccccgcggactaagcttggggcctggctgttatcctagtacctgtgtgcttatgtccgtgtgtgtccgtgtggcctggaggagcccgagggagtgccaaaccgcttcgcgagaaataaaaacgatcctttaatcaca

SEQ ID NO: 193472 - DNA, 945 bp, Homo sapiens
  Payload ID: 18196
  Gene Name: transmembrane protein 114
  Uniprot ID: B3SHH9
  ENST ID: ENST00000620492
  CDS Start-End: 1-672
atgcgggtgcacctgggcgggctggccggcgcggctgcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccgggtgcagagcccgtgcacaccgctgatgaaccccttcaggctggagaacgtgacagtcagcgaatcgagccggcaacttctcaccatgcatgggacatttgtgattctgctgccgctcagcctgatcctgatggtttttggggggatgacggggtttctgagcttcctcctccaagcctacctcctcctcctgctcactggaattctcttcctctttggagccatggtgaccctcgctgggatcagcgtctacatagcgtattcagccgccgccttccgggaggcgctgtgtctcttggaggagaaggccctcctggaccaggtggacatcagcttcggctggtccctggccctgggctggatcagcttcatcgccgagctgctcaccggggcagccttcctggcagcagcccgcgagctcagcctgagacggaggcaggaccaggccatatgagcctgggcgctgggtcgtggaggggagggaggggcttggccccggagcttcaccgaccgatctccatcggctgcggcctcttcttcctcaaaggccactcggggaggccaggcacccccctccttcccccacaaatccccgcggactaagcttggggcctggctgttatcctagtacctgtgtgcttatgtccgtgtgtgtccgtgtggcctggaggagcccgagggagtgccaaaccgcttcgcgagaaataaaaacgatcctttaatcaca

SEQ ID NO: 193473 - DNA, 560 bp, Homo sapiens
  Payload ID: 18196
  Gene Name: transmembrane protein 114
  ENST ID: ENST00000624696
  CDS Start-End: 1-534
atgcgggtgcacctgggcgggctggccggcgcggctgcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccgggtgcagagcccgtgcacaccgctgatgaaccccttcaggctggagaacgtgacagtcagcgaatcgagccggcaacttctcaccatggtgaccctcgctgggatcagcgtctacatagcgtattcagccgccgccttccgggaggcgctgtgtctcttggaggagaaggccctcctggaccaggtggacatcagcttcggctggtccctggccctgggctggatcagcttcatcgccgagctgctcaccggggcagccttcctggcagcagcccgcgagctcagcctgagacggaggcaggaccaggccatatgagcctgggcgctgggtcgtggagggga

SEQ ID NO: 193474 - DNA, 2197 bp, Homo sapiens
  Payload ID: 18197
  Gene Name: transmembrane protein 115
  Uniprot ID: Q12893
  ENST ID: ENST00000266025
  CDS Start-End: 548-1603
ccaaggactccgtatcccagcatgcagaggagccggaagacaggcgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgac

SEQ ID NO: 193475 - DNA, 1403 bp, Homo sapiens
  Payload ID: 18198
  Gene Name: transmembrane protein 116
  Uniprot ID: Q8NCL8
  ENST ID: ENST00000355445
  CDS Start-End: 172-1080
gaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattattta

SEQ ID NO: 193476 - DNA, 599 bp, Homo sapiens
  Payload ID: 18198
  Gene Name: transmembrane protein 116
  ENST ID: ENST00000546537
  CDS Start-End: 198-455
agttccgttcctgctccgcttgaggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggggagacggggtttcgccatgtttgccaggctggtcctgaatgcctgacctcaagtgattcaccgcttgggcctcccaaagtgctgggattacaggtgtgagccactgcacctggcctccttaaatgtatctttatggcctaattttcacctttgcacccagttggtgatagattatacttgtcgagtttgt

SEQ ID NO: 193477 - DNA, 640 bp, Homo sapiens
  Payload ID: 18198
  Gene Name: transmembrane protein 116
  ENST ID: ENST00000550037
  CDS Start-End: 116-640
cggctgctcaagggtagctgggactgaagtccctatgacctttccactagacgctagcattctggaggacagttgggacttggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcaca

SEQ ID NO: 193478 - DNA, 319 bp, Homo sapiens
  Payload ID: 18198
  Gene Name: transmembrane protein 116
  ENST ID: ENST00000546962
  CDS Start-End: 96-319
gaagtccctatgacctttccactagacgctagcattctggaggacagttgggacttggtaaggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggtgagtgctacaag

SEQ ID NO: 193479 - DNA, 660 bp, Homo sapiens
  Payload ID: 18198
  Gene Name: transmembrane protein 116
  ENST ID: ENST00000551297
  CDS Start-End: 175-417
ggagaagcgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagttctggaggctggaaggtccaagattaagataatcagcagatctggtgtctgatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaactt

SEQ ID NO: 193480 - DNA, 1408 bp, Homo sapiens
  Payload ID: 18198
  Gene Name: transmembrane protein 116
  Uniprot ID: Q8NCL8
  ENST ID: ENST00000552374
  CDS Start-End: 144-1157
tagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagac

SEQ ID NO: 193481 - DNA, 1716 bp, Homo sapiens
  Payload ID: 18198
  Gene Name: transmembrane protein 116
  ENST ID: ENST00000547878
  CDS Start-End: 164-406
aagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagttctggaggctggaaggtccaagattaagataatcagcagatctggtgtctggggagacggggtttcgccatgtttgccaggctggtcctgaatgcctgacctcaagtgattcaccgcttgggcctcccaaagtgctgggattacaggtgtgagccactgcacctggcctccttaaatgtatctttatggcctaattttcacctttgcacccagttgatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattattt

SEQ ID NO: 193482 - DNA, 1229 bp, Homo sapiens
  Payload ID: 18198
  Gene Name: transmembrane protein 116
  ENST ID: ENST00000549537
  CDS Start-End: 523-978
cgccaagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagac

SEQ ID NO: 193483 - DNA, 615 bp, Homo sapiens
  Payload ID: 18198
  Gene Name: transmembrane protein 116
  ENST ID: ENST00000549425
  CDS Start-End: 297-615
gtacagagcaggattcagtataggaggagcccagctgggataggggtggagccacctgttcactgcttcaggattcagaacctgactaggaaggatcggctgctcaagggtagctgggactgaagtccctatgacctttccactagacgctagcattctggaggacagttgggacttgttttctctcccaggtttcttttttcttaaactcctggcctcaagtgatcgtcttacctcagcctctcaaagtgtcgggattacaggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtaa

SEQ ID NO: 193484 - DNA, 571 bp, Homo sapiens
  Payload ID: 18198
  Gene Name: transmembrane protein 116
  ENST ID: ENST00000550233
  CDS Start-End: 418-571
actagacgctagcattctggaggacagttgggacttggtaaggtcagaagctctccctgtcttcctttgtattttccctttcttctttcctgttctgcatttttcactcacaatctcttttcatactactaacttttcttcagtttctctgttttactagtctatctttcctctttctacctatcagtgaactctagtatttgtctcttctgttacctattctttccacacatctctgtattctctctcaacatttaactttttctacccactctacattttgttcttccttttattagttttctctcccaggtttcttttttcttaaactcctggcctcaagtgatcgtcttacctcagcctctcaaagtgtcgggattacaggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatg

SEQ ID NO: 193485 - DNA, 1446 bp, Homo sapiens
  Payload ID: 18198
  Gene Name: transmembrane protein 116
  Uniprot ID: Q8NCL8
  ENST ID: ENST00000550831
  CDS Start-End: 370-1107
gcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattatttatatgtgtcatttcaaa

SEQ ID NO: 193486 - DNA, 718 bp, Homo sapiens
  Payload ID: 18198
  Gene Name: transmembrane protein 116
  ENST ID: ENST00000550800
  CDS Start-End: 407-718
ctcaagggtagctgggactgaagtccctatgacctttccactagacgctagcattctggaggacagttgggacttgttttctctcccaggtttcttttttcttaaactcctggcctcaagtgatcgtcttacctcagcctctcaaagtgtcgggattacaggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatg

SEQ ID NO: 193487 - DNA, 2758 bp, Homo sapiens
  Payload ID: 18199
  Gene Name: transmembrane protein 117
  Uniprot ID: Q9H0C3
  ENST ID: ENST00000266534
  CDS Start-End: 128-1672
gtctcgccgcgcttcccagcgaggccgccggcgcgccgagggctgtgctcgaccgcgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatgggagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagca

SEQ ID NO: 193488 - DNA, 2607 bp, Homo sapiens
  Payload ID: 18199
  Gene Name: transmembrane protein 117
  ENST ID: ENST00000546868
  CDS Start-End: 73-495
cgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatggggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagcagtga

SEQ ID NO: 193489 - DNA, 2643 bp, Homo sapiens
  Payload ID: 18199
  Gene Name: transmembrane protein 117
  ENST ID: ENST00000551577
  CDS Start-End: 143-949
cgacgccgccggcccgtctcgccgcgcttcccagcgaggccgccggcgcgccgagggctgtgctcgaccgcgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatgggagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagca

SEQ ID NO: 193490 - DNA, 576 bp, Homo sapiens
  Payload ID: 18199
  Gene Name: transmembrane protein 117
  ENST ID: ENST00000550495
  CDS Start-End: 101-576
tgaaggtgcttctatggctacttgccattctcacaggactaatagctggcaaatttctgttccatcagcgtttgtttgagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtt

SEQ ID NO: 193491 - DNA, 2707 bp, Homo sapiens
  Payload ID: 18200
  Gene Name: transmembrane protein 119
  Uniprot ID: Q4V9L6
  ENST ID: ENST00000392806
  CDS Start-End: 170-1021
aggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccataaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcacacctgtaatctcagcattttgggaggccaagtgcggacatcacttgagaccaggagttccaaaccagccctggcaacattgtgagacccatctctataaaaacaaaaaacagtccactaaatcagccacattaattgggaatcatatgtcacaggtcatttgtggggcaaacatcactgcttttccatcaagggagcaaagaataagtgggagttttggaagagtttggatgagagacgccaaggtgcccagcgttcgtaaggcaacatgcagcctggcgtgaagcagtattttgaaactgcaaatggttcccttcttgtgtcctttcaatgctgaatattttagtgtcattctgcctgtgctcagagctccagcagcagaagtgtgtgtggttaattaggacacttctgtgagaggacccctgcacacattacgacaggtccctaaatgagcatttcccaaactaggttccccgaggcactctacggaaacaagatttttttttttgagacggagtctcggtctgtcacccaggctggagtgcagtggtgcaatcttggtgcaatcttggctcagtgcaatccgcctcccaggttcaagcgattctcccgcctcagtagctgggattacaggtgcccaccactgcgcccagctaaattttgtatttttagtagagatggggcttcaccatgttggccaggctggtctggaactcctgaccttcaggtgatccacctgcctctgcctcccaaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcctgaa

SEQ ID NO: 193492 - DNA, 567 bp, Homo sapiens
  Payload ID: 18200
  Gene Name: transmembrane protein 119
  ENST ID: ENST00000549447
  CDS Start-End: 436-567
attcggcgggagcacccagtcctgtacgccaaggaactggttcttgctctgtcacccaggctggagtgcagtgccaactccgctcactgcagcctcaacttcccgggctcaggcgattctcccacctcggtctcctcggtacctgggaccacaagtgtgcgccactaggcctggctaatttttggtgtttttagtagagacagaattttgccgtgttgaccaggctggtcttgaactcctgagctcaggtgatcctcccaccttggcctcccaaagtgctgggattacaggcatgagccaccgcacccagctgatgcgatccatttcaatgaaagctgtgtcacagagaagcctcaggtcacctggaacaagcccctcaatggcccaacctggttcctacctcacctccagaatcctcacggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggcc

SEQ ID NO: 193493 - DNA, 486 bp, Homo sapiens
  Payload ID: 18200
  Gene Name: transmembrane protein 119
  ENST ID: ENST00000547567
  CDS Start-End: 403-486
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggttcttgctctgtcacccaggctggagtgcagtgccaactccgctcactgcagcctcaacttcccgggctcaggcgattctcccacctcggtctcctcggtacctgggaccacaagtgtgcgccactaggcctggctaatttttggtgtttttagtagagacagaattttgccgtgttgaccaggctggtcttgaactcctgagctcaggtcctgggggcaccatggtttcggcggcagcccccagcctcctcatccttctgttgctgctcctggggtctgtgcctgctaccgacgcccgctctgtg

SEQ ID NO: 193494 - DNA, 575 bp, Homo sapiens
  Payload ID: 18200
  Gene Name: transmembrane protein 119
  ENST ID: ENST00000549031
  CDS Start-End: 155-575
ctgtctgtctcagcctgccctggggacccgaggtcagggaggaagtgccgcatctggtcttccccagagcgagagtcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccataaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccaga

SEQ ID NO: 193495 - DNA, 1456 bp, Homo sapiens
  Payload ID: 18201
  Gene Name: transmembrane protein 120A
  Uniprot ID: Q9BXJ8
  ENST ID: ENST00000493111
  CDS Start-End: 90-1121
cggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggtggcctgagcgtgtgtgttctcctgggggaggggagggctgggtggccccaccacatgggttcctggggtctgagttagttaagttgatgcaggtggaggtcccagatctactcacacaataccaggcaaatacagaaaacagaacttta

SEQ ID NO: 193496 - DNA, 765 bp, Homo sapiens
  Payload ID: 18201
  Gene Name: transmembrane protein 120A
  ENST ID: ENST00000480899
  CDS Start-End: 1-690
agcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgagccggggtccctggacaggatggatggggggccaggcccatgtccagccctcaccctattcctccggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggc

SEQ ID NO: 193497 - DNA, 641 bp, Homo sapiens
  Payload ID: 18201
  Gene Name: transmembrane protein 120A
  ENST ID: ENST00000493251
  CDS Start-End: 1-300
ggtgccaggaccctccgggaagcaggaacaggcgctgggggtgatggtggctctctgctccaggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccaga

SEQ ID NO: 193498 - DNA, 1444 bp, Homo sapiens
  Payload ID: 18201
  Gene Name: transmembrane protein 120A
  ENST ID: ENST00000417509
  CDS Start-End: 47-1015
ggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggtgggcagggcgggccctgagggaggggagcatggaatggggtgccaggaccctccgggaagcaggaacaggcgctgggggtgatggtggctctctgctccaggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgagccggggtccctggacaggatggatggggggccaggcccatgtccagccctcaccctattcctccggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggtggc

SEQ ID NO: 193499 - DNA, 1352 bp, Homo sapiens
  Payload ID: 18201
  Gene Name: transmembrane protein 120A
  ENST ID: ENST00000440632
  CDS Start-End: 87-1055
aagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggtgggcagggcgggccctgagggaggggagcatggaatggggtgccaggaccctccgggaagcaggaacaggcgctgggggtgatggtggctctctgctccaggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgt

SEQ ID NO: 193500 - DNA, 590 bp, Homo sapiens
  Payload ID: 18201
  Gene Name: transmembrane protein 120A
  ENST ID: ENST00000485200
  CDS Start-End: 69-590
gcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatgggtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtg

SEQ ID NO: 193501 - DNA, 660 bp, Homo sapiens
  Payload ID: 18201
  Gene Name: transmembrane protein 120A
  ENST ID: ENST00000490656
  CDS Start-End: 1-307
cttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggtg

SEQ ID NO: 193502 - DNA, 1161 bp, Homo sapiens
  Payload ID: 18201
  Gene Name: transmembrane protein 120A
  ENST ID: ENST00000439537
  CDS Start-End: 5-1114
agccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggtg

SEQ ID NO: 193503 - DNA, 2766 bp, Homo sapiens
  Payload ID: 18202
  Gene Name: transmembrane protein 120B
  Uniprot ID: A0PK00
  ENST ID: ENST00000342607
  CDS Start-End: 145-1164
agttgcgcgcgtggctctggctgcgcaggaacagctggtgcctccgagggcggtcggcgagcgcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggaagggttccagtcctggatgtggcggggcctcacctttctcctgcccttcctcttctgtggccatttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagacccaccgcgtctgcctcgtgctcttcttgcccctggagcgctgggggcatcctgagtcaggctgtgagaagattcgccaccagagggcgccccgggccctgggtcgtccaaggggacaaggacgttcccgtctgtgcttcggggttccctgacccccccatcctgcagcccaccttcctgcagtgtcgtggcaggcgacaccgactcctaggcgccctccagagccaagcagcttgcgacttctggtaggcaccggaatcccctgggatgcttgttttaaaagtcctgggccgggcacggtggctcacgcctgtaatcccagcactttgggaggctaaggcgggtggatcacgaggtcaggagttcaagaccagcctggccaacatggtgaaaccctgtctctactaaaaatacaaaaattagccggacgtggtggtgtgcgcatgtagtcccagctactcaggaggctgaggcaagagaatcgcttgaacccaggaggtggagcttgcagtgagccaagatcatgccactgcactctagcctgagtgacagaatgagactctgtcccaaaaaaaaaaaaaaaaaaaaattcccagaccctcggccccagaccttcccaaaggaggctcagggattaggtatctggctgttggtgacacaggtggtctatgaaccagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggt

SEQ ID NO: 193504 - DNA, 7461 bp, Homo sapiens
  Payload ID: 18202
  Gene Name: transmembrane protein 120B
  Uniprot ID: A0PK00
  ENST ID: ENST00000449592
  CDS Start-End: 102-1121
ccgagggcggtcggcgagcgcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggaagggttccagtcctggatgtggcggggcctcacctttctcctgcccttcctcttctgtggccatttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagacccaccgcgtctgcctcgtgctcttcttgcccctggagcgctgggggcatcctgagtcaggctgtgagaagattcgccaccagagggcgccccgggccctgggtcgtccaaggggacaaggacgttcccgtctgtgcttcggggttccctgacccccccatcctgcagcccaccttcctgcagtgtcgtggcaggtacttggagagtgggaccaagacccttggcccctgtggaggggaaccacctcccccctccttcccagagcttctggatgttgtgggagggaggtgggggtgcctggcaggctcacccccaggggccgcaccctgaggcggggtcagagccactgggcatcgcttgggtgagattctgcattcgacgggaggcagagaggccaccaggtttggctgagtgctctgccccaccattcatatatgggcctcagctccccctaactgtggccctacaaatccctaggccagacctcacagcagtgcccacaggcatgccttgtttagccctcctcaaggaattttaaaatttttaattactttttttttttttgagacagggtctgttgcctaggcgggagtgcagtggcatcataggtcactgtagcctccgcctccagggctcaagggatcctcccacctcagcctctggagtagctgggaccacaatcacacaccaccatgccctgctccttttttttttttttttttgagatgggagtctcgatctgttacccaggctggagtgcagtgacacaatctcagctcactgcaacctctgcctcccaggttcaagtgattctcctgcctcagcctcccgagtaactgggactacaggcgcgtgccaccatgcctggcttttgttttgttttgttttgttttgtatttttagtagagacagggtttcaccatgtttgccaggatagtctcgatctcttgaccttgtgatctgcctgcctcagcctcccaaagtgctgggattacaggtgtgagccaccatgcctggtcaccctgctactttttaatactttttagtagagatggggtctcactatgttgcccaggctggtctccaactcatgggctcaactcatcctcctatcttggcctcccaaagcgctgggattacaggtgtgagccactgtgcctggcctgattacatttttaaaatgagatttccccacccctacagtgagattccacataaaaatccagatttctgctttccctagaaaaacggacctggcaacattcccgtggcacaggacgcctactctccagttgccacaggccctgccacccccctgcccttcattctggtctcctttctggtcctttttaggcacctgcgtttgccctagattaggagtcagctagctgtctgtaaagggccagatggcaactattttgagctttatgggccaggtggtttgtggcagctactcttcacctgcagccccagagcacaaggcaatgcagaaaggaatgggtgttgctgtgttccaataaaactttatttacaaatcaggctgtggccagatgtggcccacaggctgtagttgttggacctctaccgtagaccatcatgaggcctggggttcttcgagaacaagaactccttggttgattccccagggtacggcagggccttgggaacctgggtgggttggggagggtctcagaaggctccttcctttggcaacctgacttcttggaagctcaggtttagctgacgccccagcactgggccaggggggctgaggcaggagatatggggaaggctaggagttgcctgaagccattatcccatcttaggcgacaccgactcctaggcgccctccagagccaagcagcttgcgacttctggtaggcaccggaatcccctgggatgcttgttttaaaagtcctgggccgggcacggtggctcacgcctgtaatcccagcactttgggaggctaaggcgggtggatcacgaggtcaggagttcaagaccagcctggccaacatggtgaaaccctgtctctactaaaaatacaaaaattagccggacgtggtggtgtgcgcatgtagtcccagctactcaggaggctgaggcaagagaatcgcttgaacccaggaggtggagcttgcagtgagccaagatcatgccactgcactctagcctgagtgacagaatgagactctgtcccaaaaaaaaaaaaaaaaaaaaattcccagaccctcggccccagaccttcccaaaggaggctcagggattaggtatctggctgttggtgacacaggtggtctatgaaccagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggtggagatgggaggggtgggtgccaggctgcagcctgtgtcctcctgataggcccagccccctcggtggcctccgtgttcctgggggaaggaaggaaggagctggaggatacagtggtgcctatctcgggagcccagggaggcagggacacaggagtggcaggcttggggcgcccgcgtggaacagtgccaggtctacgtttacccactaccagatagactttttcatttcaagcataacttgagtctgcactggggagacactcgtggtgggggtggctgtgatgagggcacttgcgagtcccgacaacagacactggctcctgcacccacatcaccaccatgtcccaggggcagcctggaggggagtttgtggtcagagccccagccaggaaaggagagagttccagaatgttccaagagtctagccgcaggccccagacaccatgagctggagggtcgggatggggcagcctccctggtgcaatcggcacctgggcccccgggccctgtcagtgctgtcgtgaggtctgtctgccctgggtcagagcagcaggcagagccggcgcttcttctgccgttgcgccttcttcagagcgctgagagccaccttggcggcctcccggaagacgtcctccacattctcccgaaacttggcggaacattccaggtagagagcagctcggatctgttcgcaggcgctcaggccctgggtggggggaggagccagcattaggtgaggggcccctggaggtctcctagcaccacctggtgggtttgggactggctctgaggactctgcagggatggaggccttggtttgggcctgtctgtctcctccatcctggctgcccctcacagtgtgtgggtggaatggagggccagggcagtgcagcccgcaggttggaagaagccctgtccaggcccccaccctggcctctctccagctccgggcagggaggggctgaatcctgagacccggggttggttcccccaggtgtctcccaggcctgtgagaagagttggaggcctcaagacagaaaggacttccagccacctctctcccttctctgaaagtaccatttaggcaaattaatttgcccttttatttatttatttttgagatggagttttgctcttgttacccaggctggagtgcaatggcgcgatcttggttcatcacaacctctgccacccaggttcaagcgattctcctgcctcagcctcccgagtagctgggattacaggcatgcgccaccatgcccggctaatgttgtatttttagtagagatggggtttctctcatgttggtcaggctggtctcaaactcccaacctcaggtgattcgcccgcctcggcctcccaaagtgctgggattacaggcgtgagccactatgcccggccggatttgcccttattaatggttatttcttgtgaaagtttctttttgcctttgcattccttttattctgtttattcccccatgcctcacccaaagagttgcacggtcaattggcccgtgaaggggacgcctactttcaaacaaggcagacaggacacgacaggacggcggctcatagcacagactttggattgcagtggatgggaccagatcctggctccacttctcgctagctgtgtggccctgggcaagctgcttaacctctctgggcctcagtttctccccctgtaaactgggggatgtgaacagcgcctgcctccgagtcctaaggattgggagtagtcgtgtaaagtgctcaggtccacaggccatcaatactaatagttaaaaattattcttagaatcttgcttccctcagctccctgaaaggccactaaggcaccccagttgcagaggccaaaggtccgggaggcttcacagccacggctgtgccccagggtcttggccccggcccacctgcatgtaggtgatgggctccagctgggcggcccggagcttccgcagctgctccttgtccttcctcaggtctgtcttgcagccgatgagcaccatggggatcccgcggcagaaatgcgtgacctcagggaaccactgtggagggaggaggcgggatcaggggtgcggccgggcccagatgtggggccaccacccaggaggccggcctcaccttgatgaggacgttgtcgtagctggtgggattcatgacgtcatagcagatgagcacgaggtgggtgttctggtaggacaggggccgcagccggtcatagtcttcttgccctgaaagcacagagcagcgggggtcaggggacgtcccctccctgtctggactctgacgggtgaaggggaaggggccaggcaagtgaccctgccttagggcctcaatttcctcatctatacaatgggcagcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtgatccccctgccctgatggtcaagggcagagtgcagactggaaccctcccctccccaaagattcagacctgtggggctgagtgggctcatagtgtccccaagtcctgagaggctggtgtctggcttcagcctccagcttctcaggttctgatgcagtcagctgagttccctgcctattcttgcaagcactaggaggagggtggtgggttgctgggaacagcaccgagcgccctccccacccagattcacagagcacactccctggggggatactttaatccggaggccgtgacgcctggctccgccccgagacgagctgaatccaaatacggatctaggcttgagcttggttgggtttgcttttttcttcttcttctttataaacaattctttgtaactttttgtattgacagtttcaaacttacagtaaaattgcaacacgag

SEQ ID NO: 193505 - DNA, 2959 bp, Homo sapiens
  Payload ID: 18202
  Gene Name: transmembrane protein 120B
  ENST ID: ENST00000541467
  CDS Start-End: 1-744
cttcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagacccaccgcgtctgcctcgtgctcttcttgcccctggagcgctgggggcatcctgagtcaggctgtgagaagattcgccaccagagggcgccccgggccctgggtcgtccaaggggacaaggacgttcccgtctgtgcttcggggttccctgacccccccatcctgcagcccaccttcctgcagtgtcgtggcaggtacttggagagtgggaccaagacccttggcccctgtggaggggaaccacctcccccctccttcccagagcttctggatgttgtgggagggaggtgggggtgcctggcaggctcacccccaggggccgcaccctgaggcggggtcagagccactgggcatcgcttgggtgagattctgcattcgacgggaggcagagaggccaccaggtttggctgagtgctctgccccaccattcatatatgggcctcagctccccctaactgtggccctacaaatccctaggccagacctcacagcagtgcccacaggcatgccttgtttagccctcctcaaggaattttaaaatttttaattactttttttttttttgagacagggtctgttgcctaggcgggagtgcagtggcatcataggtcactgtagcctccgcctccagggctcaagggatcctcccacctcagcctctggagtagctgggaccacaatcacacaccaccatgccctgctccttttttttttttttttttgagatgggagtctcgatctgttacccaggctggagtgcagtgacacaatctcagctcactgcaacctctgcctcccaggttcaagtgattctcctgcctcagcctcccgagtaactgggactacaggcgcgtgccaccatgcctggcttttgttttgttttgttttgttttgtatttttagtagagacagggtttcaccatgtttgccaggatagtctcgatctcttgaccttgtgatctgcctgcctcagcctcccaaagtgctgggattacaggtgtgagccaccatgcctggtcaccctgctactttttaatactttttagtagagatggggtctcactatgttgcccaggctggtctccaactcatgggctcaactcatcctcctatcttggcctcccaaagcgctgggattacaggtgtgagccactgtgcctggcctgattacatttttaaaatgagatttccccacccctacagtgagattccacataaaaatccagatttctgctttccctagaaaaacggacctggcaacattcccgtggcacaggacgcctactctccagttgccacaggccctgccacccccctgcccttcattctggtctcctttctggtcctttttaggcacctgcgtttgccctagattaggagtcagctagctgtctgtaaagggccagatggcaactattttgagctttatgggccaggtggtttgtggcagctactcttcacctgcagccccagagcacaaggcaatgcagaaaggaatgggtgttgctgtgttccaataaaactttatttacaaatcag

SEQ ID NO: 193506 - DNA, 962 bp, Homo sapiens
  Payload ID: 18202
  Gene Name: transmembrane protein 120B
  ENST ID: ENST00000540377
  CDS Start-End: 397-675
ttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaaggctgcgtccagttcctgcaatattattaccagaggggctgcctctaccggctgcgggccctgggggagaggaaccacctggatctcacagtggaagggttccagtcctggatgtggcggggcctcacctttctcctgcccttcctcttctgtggccatttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtg

SEQ ID NO: 193507 - DNA, 1532 bp, Homo sapiens
  Payload ID: 18203
  Gene Name: transmembrane protein 121
  Uniprot ID: Q9BTD3
  ENST ID: ENST00000392519
  CDS Start-End: 165-1124
agaggctgggcgggcgggcccgggagcggcgcagcatctgcgggcggcggggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggcc

SEQ ID NO: 193508 - DNA, 1519 bp, Homo sapiens
  Payload ID: 18203
  Gene Name: transmembrane protein 121
  Uniprot ID: Q9BTD3
  ENST ID: ENST00000431372
  CDS Start-End: 152-1111
cgcgcctggtgggaagcacgcggggtgcggggggcggggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggcc

SEQ ID NO: 193509 - DNA, 3321 bp, Homo sapiens
  Payload ID: 18204
  Gene Name: transmembrane protein 123
  Uniprot ID: Q8N131
  ENST ID: ENST00000361236
  CDS Start-End: 217-786
cccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaa

SEQ ID NO: 193510 - DNA, 3579 bp, Homo sapiens
  Payload ID: 18204
  Gene Name: transmembrane protein 123
  Uniprot ID: Q8N131
  ENST ID: ENST00000398136
  CDS Start-End: 422-1048
aaaggcttccttccgggcaccgcgaagccagcgtgctcagcattcagggaggcagcggcgctcgccttcatccaggacaacaaaactgccatttccgaagagaaaggaaacggctcgcggtttctggggttcccaagcgcgcgcctgcgagggaggccgcgagccgagtcgccacgcccagaaccccgagcccgcccccgcgccacccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttct

SEQ ID NO: 193511 - DNA, 568 bp, Homo sapiens
  Payload ID: 18204
  Gene Name: transmembrane protein 123
  ENST ID: ENST00000531103
  CDS Start-End: 503-568
aacgaataaagcactctgaaaagttgcttaattgggacatagaaatctcttacattttttccaaatctaaaggtgtactaatttaaaaattaaaaccctactgagaaggtgcagttaaataagaaaatcctattttatccctccattgtatgaaattaggggtgttggttgggtggtgcaagacctagagatgcctgtgagtagaatcggcctctcctgaaatggtccactccactcagaagagcagagtcctcagtggcagaaattggcccatctgtccccaattgtgtgggtaaatgaattttggcaaagctgttgcattcggtggctggtatatacatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctacc

SEQ ID NO: 193512 - DNA, 568 bp, Homo sapiens
  Payload ID: 18204
  Gene Name: transmembrane protein 123
  ENST ID: ENST00000528969
  CDS Start-End: 195-557
tgtttcaatgaattaccgattagagaaactcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatg

SEQ ID NO: 193513 - DNA, 743 bp, Homo sapiens
  Payload ID: 18204
  Gene Name: transmembrane protein 123
  ENST ID: ENST00000532161
  CDS Start-End: 338-700
aggtttggaccagtcacccgctggccccggggccgcctgctgaggaaattgcctggtgcttcccctctcgctttttggatgcggcggtcgcaggccgggacgggtgcgcataacctgttgagttaccgcaagttggtttttacagcctttccctgaagttaatgtttgccgagcatctgcaaacatagagaattctgggcttccacacaactccagtgctaactcaacagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccc

SEQ ID NO: 193514 - DNA, 467 bp, Homo sapiens
  Payload ID: 18204
  Gene Name: transmembrane protein 123
  ENST ID: ENST00000526676
  CDS Start-End: 329-467
agtcacccgctggccccggggccgcctgctgaggaaattgcctggtgcttcccctctcgctttttggatgcggcggtcgcaggccgggacgggtgcgcataacctgttgagttaccgcaagttggtttttacagcctttccctgaagttaatgtttgccgagcatctgcaaacatagagaattctgggcttccacacaactccagtgctaactcaacaggcagactcaacccaaacacttggtgaggcccttaccctgtgattttagtttgggacaaagccttgggcctctgagttcactaacatggaaagatgcaagaaccaggctgatgtcatcaatatcagtagtaaatcatcaagagactctccaacatgtgccttctgaccatacaaatgaaacttccaacagtactgtgaaaccaccaacttcagttgcctcagactccagtaatacaacggtcaccacca

SEQ ID NO: 193515 - DNA, 567 bp, Homo sapiens
  Payload ID: 18205
  Gene Name: transmembrane protein 125
  ENST ID: ENST00000456751
  CDS Start-End: 521-567
ggaatgctgggactgactccacggccacgcccacctcccccacttccttgagagcatcggcaccagcccccgcccacctcgggggtaggggtcagcctctgcagaggagtctccgggaggacagatacctcgtcaggatgtaacctgtgcacggccacatagtaatattcccagaatgacccaggacctacgtcttctgccctgtcctgccttggagggctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgccccc

SEQ ID NO: 193516 - DNA, 1850 bp, Homo sapiens
  Payload ID: 18205
  Gene Name: transmembrane protein 125
  Uniprot ID: Q96AQ2
  ENST ID: ENST00000432792
  CDS Start-End: 571-1230
catttgagggagaatgagcacggggcttttggaggctgcagcctagggccaagggatggaggaatgcctcagcccagcagaaggagcagtgccacgtcagccaatcggctcaggccctgccctggaaacgacacctgttcatcctcctcccggcaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctcca

SEQ ID NO: 193517 - DNA, 1786 bp, Homo sapiens
  Payload ID: 18205
  Gene Name: transmembrane protein 125
  Uniprot ID: Q96AQ2
  ENST ID: ENST00000439858
  CDS Start-End: 507-1166
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctcca

SEQ ID NO: 193518 - DNA, 739 bp, Homo sapiens
  Payload ID: 18206
  Gene Name: transmembrane protein 126A
  Uniprot ID: Q9H061
  ENST ID: ENST00000304511
  CDS Start-End: 110-697
aaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacag

SEQ ID NO: 193519 - DNA, 726 bp, Homo sapiens
  Payload ID: 18206
  Gene Name: transmembrane protein 126A
  ENST ID: ENST00000525353
  CDS Start-End: 131-250
acgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaagttctttcttctcaccctttcaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaac

SEQ ID NO: 193520 - DNA, 643 bp, Homo sapiens
  Payload ID: 18206
  Gene Name: transmembrane protein 126A
  Uniprot ID: Q9H061
  ENST ID: ENST00000532180
  CDS Start-End: 224-601
gccacagtgaactccggcgtggctgaggaaggaggaggcacccacaggctgctgggaggagagcataagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacag

SEQ ID NO: 193521 - DNA, 656 bp, Homo sapiens
  Payload ID: 18206
  Gene Name: transmembrane protein 126A
  Uniprot ID: Q9H061
  ENST ID: ENST00000528105
  CDS Start-End: 238-615
acgagtcagccaaagatggctgcgcccaggtaatttgagcaaaggccacagtgaactccggcgtggctgaggaaggaggaggcacccacaggctgctgggaggagagcataaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaaca

SEQ ID NO: 193522 - DNA, 722 bp, Homo sapiens
  Payload ID: 18206
  Gene Name: transmembrane protein 126A
  ENST ID: ENST00000531366
  CDS Start-End: 111-398
caaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtgatttggattgtgaaacctgtaccataacacggagtggactgactggtcttgttattggtggtctataccctgttttcttggctatacctgtaaatggtggtctagcagccaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacagttta

SEQ ID NO: 193523 - DNA, 989 bp, Homo sapiens
  Payload ID: 18207
  Gene Name: transmembrane protein 126B
  Uniprot ID: Q8IUX1
  ENST ID: ENST00000358867
  CDS Start-End: 24-716
ggcaagtcacatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaa

SEQ ID NO: 193524 - DNA, 1210 bp, Homo sapiens
  Payload ID: 18207
  Gene Name: transmembrane protein 126B
  Uniprot ID: Q8IUX1
  ENST ID: ENST00000393375
  CDS Start-End: 298-900
tccccgcccaccggcaagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaaatgg

SEQ ID NO: 193525 - DNA, 376 bp, Homo sapiens
  Payload ID: 18207
  Gene Name: transmembrane protein 126B
  ENST ID: ENST00000531274
  CDS Start-End: 1-376
ctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgcttcaagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttgg

SEQ ID NO: 193526 - DNA, 1388 bp, Homo sapiens
  Payload ID: 18207
  Gene Name: transmembrane protein 126B
  ENST ID: ENST00000528361
  CDS Start-End: 12-134
gagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcaggtgaatttaaattcactaatgtataacgtagttatgtctaagtaaagttacttattaacatatactgttgctactgctaataataattctttacatttatatattgctatacagtttacaaagtccatataccttgtcatatttaatccctgcaacaatcctcctaatcaggtaaactgtatttttttatttctgtagataagcaacccaaactgaggcatgttcaagtacgctaataagcaacatactgggaaaagaattggctgtggcatacaacgcacatcatttcagtatgctacctcctgccacttaagttttgtgacattcagtaaggcatttcatctctgagcctccgttgtcttatctataagttaggactaatagtacttacctcacaggattgttgtgagaattaaaagatactgtaggttaaatgactaccacaatatctgtcatattatgggcttttaatgttatttcctgcccctcaccttaccttgagtttcacaactagtaattgatagagcatctatcccttgttcattcttcaggttcctgcttaagtatcttttccccagggagacctctgattgcctcattgtacactaggtgtctggatacattctctatatagtttatcttcaaagtattgtgtacactgataattatctatttaaatatttatctcgtgtctttcatctctgtaaactggccagaaggtcagagatcaggtctcttttatgtaccaccgtattcctagctcctagcacgttcctgatatatagtagataataaaaatgtattaacc

SEQ ID NO: 193527 - DNA, 853 bp, Homo sapiens
  Payload ID: 18207
  Gene Name: transmembrane protein 126B
  ENST ID: ENST00000526822
  CDS Start-End: 5-181
caaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaa

SEQ ID NO: 193528 - DNA, 1273 bp, Homo sapiens
  Payload ID: 18207
  Gene Name: transmembrane protein 126B
  Uniprot ID: Q8IUX1
  ENST ID: ENST00000534341
  CDS Start-End: 7-519
accaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtaagttcttccttttccttcttttttcttttcttttcttttcttttttttttttttttttaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaaa

SEQ ID NO: 193529 - DNA, 675 bp, Homo sapiens
  Payload ID: 18207
  Gene Name: transmembrane protein 126B
  ENST ID: ENST00000530783
  CDS Start-End: 12-143
gagccaccaaaatggtggtgttcgggtatgaggctgggactaagccaagggattcaggtgtggtgccggtgggaactgaggaagcgcccaagcttttttgttctgaactcccactgcgttgtggattcctgaggatgggatgactgtatcttgattacccggaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatgg

SEQ ID NO: 193530 - DNA, 478 bp, Homo sapiens
  Payload ID: 18207
  Gene Name: transmembrane protein 126B
  ENST ID: ENST00000530901
  CDS Start-End: 1-121
cgggtatgaggctgggactaagccaagggattcaggtgtggtgccggtgggaactgaggaagcgcccaagcttttttgttctgaactcccactgcgttgtggattcctgaggatgggatgactgtatcttgattacccggaggtctggcatataccacgtgctccctaaattatgagcgaatgttgaataaaattctaaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgac

SEQ ID NO: 193531 - DNA, 575 bp, Homo sapiens
  Payload ID: 18207
  Gene Name: transmembrane protein 126B
  ENST ID: ENST00000531718
  CDS Start-End: 16-138
acatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaagataatataagcaaggaaaactgtgttttcagaagctcactgattggcatagtttgtggtgttttctatcccagttctttggcttttactaaaaa

SEQ ID NO: 193532 - DNA, 820 bp, Homo sapiens
  Payload ID: 18207
  Gene Name: transmembrane protein 126B
  ENST ID: ENST00000531477
  CDS Start-End: 16-147
acatgagccaccaaaatggtggtgttcgggtatgaggctgggactaagccaagggattcaggtgtggtgccggtgggaactgaggaagcgcccaagcttttttgttctgaactcccactgcgttgtggattcctgaggatgggatgactgtatcttgattacccggaggtctggcatataccacgtgctccctaaattatgagcgaatgttgaataaaattctaaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaa

SEQ ID NO: 193533 - DNA, 1149 bp, Homo sapiens
  Payload ID: 18207
  Gene Name: transmembrane protein 126B
  ENST ID: ENST00000529197
  CDS Start-End: 4-126
aaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtt

SEQ ID NO: 193534 - DNA, 6266 bp, Homo sapiens
  Payload ID: 18208
  Gene Name: transmembrane protein 127
  Uniprot ID: O75204
  ENST ID: ENST00000258439
  CDS Start-End: 258-974
agtgcatcggccccgggtctgtccgggcgttgcgggattggggcctgggaacgctcggcccccggcagccgagaagcccgtgactgggctgagcagcaccatcccagccctggggcctgctgactgcccagtcccggcttcacctgcagcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaaccacgaataagaatggaaatgacaatggctgcctgtcatttttctgtcacgattttcctgatttggtttgttccctttgtctcagagaagcaggagatgttgatgaggctgtatttttttttctttttcttgtttttgagacaagagtctcgctctgtcacccgggctggagtgtaacgtggcatgatctcagctcactgcaacctctgcctcctgggttcaagcgattatcctgcctcagcctcctgagtagctgggattacaggcatgcgccactatgcccagataatttttttgtatttttagtagagacagggtttcaccatgttggccaggctggtctggaactcctaacctcaggttatccacccaccttggcctcccaaagtgctgggattataggcatgaaccaccgtgcctggccaaagatgtaatttaaaatagttagaagggacttggcatgggccagctccgtgcatggcattttcacccccagagcttcctaatcctgttttcacacaggaagtttctaggtctttctagaacagctagaaatagtagctgactcccgcccaaggcccaaccttcaaaccctgagctcttcaggctgcatcctctggtgagctatagaggagaacgtggctcctaaactctagccatcctgtgggaggaaatagacttctttgggctgtggcttgcagaacaaactacactttttttccctctattgtttaaattttatttaataatttgtgtgtttttctgtctttattttctgtatttcacgtgttccttcactccctagaaactgcactttctttgaaaccataggtaatgaatcttactaggagaggcatggggatagagacagttctgggagtgtgacctgtaagcctcctgtagggcagtgccaggccttgattgcccacgttctctccgttccttcttccttcatacatttgatcacacagcctacacccagccccgagtgtgcatcacggtaaaagagctgagggctctcttcagggagcagcccatttaggtctcttttgttgttgttagggagaatacacatctttcttggaagctgggagtgtgttctcatttcatgtccattcagacaaagcaccattaggcaccatgaaatatacagtgacggacaggaccctgtctgcaaggattttatgtccttagttcaggagatggacttgtccacagaaaggcagagtgaagtgggcggccggctcggaaaagtcctgtgcccagaagggagccagttctgacctgagtgataatgaaaggcttcctggaggacgcagcttgagccacacttgatgtgggagtgaactgggatagggacactcctgctgagagaatggcaagagcaaaagcacactggtggccaggaggtggtaagagccgaggttagaaaggtgaggggtgctcatttaaggcactaacagcagaaggagcccaggaaggattttcagaagggaagggagggatgcaaccttattttaatgactggtgacagtaggaagggttctgcctggccttaagtgagggtgttgaaagtgggagacaggacctgccaaaggggaagagggcggtcacagtcaatcccagggcccagtgtctcagccaggtgctggagttgggaatgcgggagccccagtctctgcccacctgtcacgtggcagctggaaggtggcatcaactgcacaggcgaagaggggcccgcacacgagaagccatgggatgtgaagggccgcaaggagaggaccctgggacacaggaagaggtggtgcatctggggcagggcggctttcccaagatgactagagaatcttcagctggcatcttgcctgaaatatccacgctctcagccactacactaatggaacacagatgctatggggagacagaagggaactgacaaacttcatgcccctgttttcaaatagcctgcaatcttacctcttcctctgcattttttggggggagtgacattttaatgggaggcaggaggtttgtggagaagagaaaatgttttttttgtgggggtgggtagagacagtctcaccatgttgcccaggctggtctcaaactactggcttcaggcaatccttctgcctcccttcccaaagggttgggattacaggcttgagccactgcaccaagcctgaaaatgtcgttttgaatgagcccacctgaaacgaagacgcttcattagggttactggtttgagaattaagatcagttctggccgggtgcggtggctcacgcctattatcccagcactttgggaggccgaggtgggtggatcacaaggtcaggagatcgagaccattctggccaacatggtgaaaccccgtctctactaaaaatacaaaaattaaccaggcatggtggcaggtgcctgtagtcccagctactcgggaggctgaggcaggagaatcacttgaacccgggaggcagaggttgcagtgagccgagatcatgccactggactccagcctgacagagtgagactccatctcaaacacacacacacacacacacacacaccacacacacacacacaggttcctcaccataagctttggggaaaattcttggcttttttgctgggggagagagcagtgcccagggaagattggctgatctcagagctggagggtttatgcgggactggccagccccttcagctgagtgggacagcaacacagtgggtggtaaggggcttcataagatgtacaagatgagggagaggcccctccagccaaccctgtgtctaaagagtcaggtaacgaagaactttccagagacagctgtgagtccgtctggcttaaggggttgtacaggtgtctgagaatggggcctgaaggtgcagggcctgcaggctgccctgtttggaaggttcctgtccttctgtcttggtagaaaatggcagctagccttgtaaagggcctccttgtgtagcgagatagaccatgtagccccagatgcccccatggcttcacttccctcttgggggtctctcagtatatgtctagtgccaccactattggtggagagtttccttctggaataaccttggggtggtggatgggttttattttaataaaagaagaatgtctcatt

SEQ ID NO: 193535 - DNA, 582 bp, Homo sapiens
  Payload ID: 18208
  Gene Name: transmembrane protein 127
  ENST ID: ENST00000435268
  CDS Start-End: 110-574
agttccatgggatcctattacagctgcctacttccctgatgactagagggcaccgccaagcagtgtttaccaaaatcaacaggccagagcacagctggaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagcc

SEQ ID NO: 193536 - DNA, 3099 bp, Homo sapiens
  Payload ID: 18208
  Gene Name: transmembrane protein 127
  Uniprot ID: O75204
  ENST ID: ENST00000432959
  CDS Start-End: 235-951
agtgcatcggccccgggtctgtccgggcgttgcgggattggggcctgggaacgctcggcccccggcagccgagaagcccgtgactgggctgagcagcaccatcccagccctggggcctgctgactgcgaacccggagcgttgctatcctccaccggactgtcaggctctgcgcgccccgcggaggtcggcggcgaccagcagcgactgcggagcgacggcgggcggccccgggcatgtacgcccccggaggcgcagggctgcccggcgggcgccggcggaggagcccgggaggcagcgctctgcccaagcagccggagcgtagcctggcctcggccctgcctggcgccctgtctatcacggcgctgtgcactgccctcgccgagcccgcctggttgcacatccacggaggcacctgttcgcgccaggagctgggggtctccgacgtgttgggctatgtgcacccggacctgctgaaagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcgtggaacccagaggggctgaggactgtggcctggctggcgggccagcgtggtgctcctcaggactgcagcactgagatggaacctggcctcagtttaggaacaggggccacaacagggcaggaacccaccaccctccacataggaatacaaccagtggggccacatcatgtgaggcatcagacccacactgtcagcccagcaggccgggctgtgtccttcagacccagtgctgccctagactctgactcgggactccagcttgccacgtgccctctcccctcttgaatgtactctggtcttgcagtgtgctgctgggactttcttgctcagccatcactctggtcaccttgtttgctctgggtctggctgaattttctgccctgagatctgggcataaagtggatgaaacttgaaagaccttcagtgtagatccagatggccaacctgtccttgttaagttacttgcttcttgggaatcagtgtcccctgctgagctgaaaaggaaatggattccaatctcttccaacctttaaggtgatagatagtttgagcaagactggagaatggacaacactatgaagctgtggctagaaagggactgtcatgtcccatcctttggccagattgactggggatgtccggacagatgcctgcatgggtggtgagggccacatctgcacacgagccagtggctgcttgcagttcactgctgtgatgccagagtgtgttcaaaggtgactctcctgctcttctggactcttctctcaggcaagaaaggctgcaggctgcctgctatgtgatgcctgagcacaaagccaaggaactgaactaagtctttctgttaagtcctgagtttgtcattggcaggtttacttgtggccagctctctctgcccttgggtgtctgagcaggcagaccagaagaccaggcactggacctgcatgccaaagggactggtcatctcctgaggacctgtaaatgaccctgtggactgttccgcacgatccggaacccactttttattcactccccatgtctttggccttcctcttctttctctttccctctgccatcctgacactgatagtttgtcatataaattccccgggttgtgtttttttttctagaaaaaaattaaaagggaaaacaaaaccaaaaaaaccagaaa

SEQ ID NO: 193537 - DNA, 1737 bp, Homo sapiens
  Payload ID: 18209
  Gene Name: transmembrane protein 128
  Uniprot ID: Q5BJH2
  ENST ID: ENST00000254742
  CDS Start-End: 588-1013
cggtaccaagatggactcctcgcgggcccggcagcagctccggcggcgattcctcctcctgccggacgccgaggcccagctggaccgcgagggtgacgccgggccgggtgaggcgcgcaccaagccgccccgaggttctcagaggcgaggcgtcggaaaacggccggcctccggcagccctggcccagtctggaaggactgagtttcggctttgcaagtcgaatatttaatgtcagggaagatccttagaatcgcggagtgctgtgcatcgtcatttcagctgcgcttcagaattctctggagagctgatttgacacctatttggaaatagcgattaaaattaaaaatacccaccagttttaagtcttaaggatttaccagaaacatgcgtgtaccgcagtgtacaatgatgtgcgcagtgtttcacttcaggattgcttgtaatagcgaattactggaaatatctgccttgcccgtcagcagaaagctgtttaagtaaatttgggtatatgtatacctgacacatcaggtcgactcgtatgtaccaatggggatgattttcaaagggaagtgtggaacactatggtatgccgccatttgggtacaaaacagaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 193538 - DNA, 1221 bp, Homo sapiens
  Payload ID: 18209
  Gene Name: transmembrane protein 128
  ENST ID: ENST00000382753
  CDS Start-End: 11-508
cggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatt

SEQ ID NO: 193539 - DNA, 2678 bp, Homo sapiens
  Payload ID: 18210
  Gene Name: transmembrane protein 129, E3 ubiquitin protein ligase
  Uniprot ID: A0AVI4
  ENST ID: ENST00000303277
  CDS Start-End: 522-1220
cggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 193540 - DNA, 2810 bp, Homo sapiens
  Payload ID: 18210
  Gene Name: transmembrane protein 129, E3 ubiquitin protein ligase
  Uniprot ID: A0AVI4
  ENST ID: ENST00000382936
  CDS Start-End: 495-1583
gccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtg

SEQ ID NO: 193541 - DNA, 761 bp, Homo sapiens
  Payload ID: 18210
  Gene Name: transmembrane protein 129, E3 ubiquitin protein ligase
  ENST ID: ENST00000480360
  CDS Start-End: 1-277
cgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcgtgactgggccaactccaaatgtggactattactttttgccaactggaacctgctggtgcaactcctcaccatctccatggcttatttggaccttcaaattgtcctcgatctggccagcagggccctgaagctggctccgtgtcctctggacatgtcccatcattctttgagacttgcttcctttctcgcacataacttttcagctctgggatgcaccacatttgatcagcctcctcagagcgggcttttgtagttttttcaacacttacgtattgtgtgaaactaaagcagcaaattaaaaaccttttccgctaatatatcctgcctttgccacaggcagggagagagtggccggctggggaagtgcagagctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttc

SEQ ID NO: 193542 - DNA, 1100 bp, Homo sapiens
  Payload ID: 18210
  Gene Name: transmembrane protein 129, E3 ubiquitin protein ligase
  ENST ID: ENST00000460722
  CDS Start-End: 1-85
ctcgccagactcgaacttgcccgtgcagctcctcaccatccgtgtggccagcaccaaccctgctgtgcaggcctttgacatctgaggggcccagcagctctcctccctgcaggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatggga

SEQ ID NO: 193543 - DNA, 2172 bp, Homo sapiens
  Payload ID: 18210
  Gene Name: transmembrane protein 129, E3 ubiquitin protein ligase
  Uniprot ID: A0AVI4
  ENST ID: ENST00000536901
  CDS Start-End: 411-1499
gccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaagg

SEQ ID NO: 193544 - DNA, 2261 bp, Homo sapiens
  Payload ID: 18211
  Gene Name: transmembrane protein 130
  Uniprot ID: Q8N3G9
  ENST ID: ENST00000345589
  CDS Start-End: 97-1062
gcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaa

SEQ ID NO: 193545 - DNA, 3015 bp, Homo sapiens
  Payload ID: 18211
  Gene Name: transmembrane protein 130
  Uniprot ID: Q8N3G9
  ENST ID: ENST00000339375
  CDS Start-End: 176-1447
ggcggcggcggcgcgcagcgacagagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcataga

SEQ ID NO: 193546 - DNA, 679 bp, Homo sapiens
  Payload ID: 18211
  Gene Name: transmembrane protein 130
  ENST ID: ENST00000445790
  CDS Start-End: 541-679
acaaaaattagccaggcctggtggcgggcacctgtaatcccatcttactagggaggctgaggcaggagaatcgcttgaacccgggaggcggaggttgcagtgagccgagatcgcgccattctgggacagagcgagactctgtctcaagattaaaaaaaaaaaaaaaagaaaagaggaagcagcagcagcagcagcagcaagaggaatttcgaggcctttcgcccaacgcctggcgcaccttaagctctcaacagttcttgaatgaggagtagcatctcggagccacgagcgtgcagagagaaggcacctggaggagagccccaagggacctgcaggcggcttgcagcgcagcgcacgcccctggggacgctgagcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacag

SEQ ID NO: 193547 - DNA, 3891 bp, Homo sapiens
  Payload ID: 18211
  Gene Name: transmembrane protein 130
  ENST ID: ENST00000450876
  CDS Start-End: 1317-2336
ttttaaatttttttttttgtagagaatgggtgtcgctgtgttgttcaggctgatctaaaactcctgggctcaagtgaccctctggcttcaaagcgctgtgattacaggtgtgagctgactgggcccggcctcaaatgcctttataatttaagaaatggctctgaaaaaaaaggaaatacgtgatgtgggccaaagcagcgaacgtgtgaggtgggcctgaggaaaggtcggagctggagtcccccacagggacaggtgatgttgctttgaagtgaatgagatgcgtctgaaaaaaataatctcagagttgcctgggcactagaaggggcttcccttgccccctcgattcctgcttctactccccgggctggccctgccctggaaaccacacgagggtggcccacgcatccgtcagatgtctggggaccatgtacctgctaagggaggggaggacgaggcagggacatggggatgtatcagggtcagtcatcgtgccacaacccccagcccccagggaacacgggatgggcagcatttttactttaaaatgttgcctcatctagaggggttttccaccctgttggtgctggctttggggagatatgattttatttgatttatgtatttatttatttgagatggaatttcgctctttttgcccaggctggagtgcagtggcgcaatctcggctcacggcaaccaccatctcccaggttcaagtaattctccggcctcagcctcccgagtagctgagattacaggcgttcgccaccacacccggctaattttgtattgttagtagagacggggtttcgccatgttggccaggccggtctcaaacgcctgacctcaggtgatccacccacctcggcctcccaaagtgctggaattacaggcatgagccaccgtgcctgaccgagatgcaattttagagcccaggaggccaggctgctatttcttccaggagtgatttcccaaaatggacctggagctgacaggttcctggggggacttgtggggggaccttgtgcccactcggtcgtgcatctactgtccccacatccccatcgccagaaggccagcacccacctttctgccacattttgggaaccataaaaggacccagattggagacttgttgagggacaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatat

SEQ ID NO: 193548 - DNA, 2881 bp, Homo sapiens
  Payload ID: 18211
  Gene Name: transmembrane protein 130
  Uniprot ID: Q8N3G9
  ENST ID: ENST00000416379
  CDS Start-End: 6-1313
ccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggaggtggctgattttgacttttcccccatgtctgacaagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcataga

SEQ ID NO: 193549 - DNA, 6640 bp, Homo sapiens
  Payload ID: 18212
  Gene Name: transmembrane protein 131
  Uniprot ID: Q92545
  ENST ID: ENST00000186436
  CDS Start-End: 230-5881
ctccgctccgactgcttgtaggcgatgcccaggcaaagaccgtgactgacactctcgctcacacgcacgcacggacccaggcccacgctcggagatcgagccccgggctcgcaaccgttgtcgctcccggcgccgcggccagagcccggaccacggcttccgcgccgccgccgcctcgccgagaagggccgcgccggacctcgagcgcggcggcccccggccggcagggatggggaagcgggcgggaggaggagcaaccggagccaccaccgccgccgtctccacgtccgccggggccgggctggaacctgcggccgcccgtagcgggggcccgcggagcgcggccgccggcctcctaggcgcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacggtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttc

SEQ ID NO: 193550 - DNA, 426 bp, Homo sapiens
  Payload ID: 18212
  Gene Name: transmembrane protein 131
  ENST ID: ENST00000409721
  CDS Start-End: 1-426
gagaatacaggacaacttcaaattcacatagaaaccattgaaatcagtggatactcatgtgaaggatatggctttaaagttgttaattgtcaagagtttactctaagtgccaatgcttctagagatataatcatatttgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagc

SEQ ID NO: 193551 - DNA, 1105 bp, Homo sapiens
  Payload ID: 18212
  Gene Name: transmembrane protein 131
  ENST ID: ENST00000418629
  CDS Start-End: 1-998
ccggcctcctaggcgcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacacatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatc

SEQ ID NO: 193552 - DNA, 565 bp, Homo sapiens
  Payload ID: 18212
  Gene Name: transmembrane protein 131
  ENST ID: ENST00000438715
  CDS Start-End: 182-565
gtgaatcttgcccaaatatttaacactggcatgggttgtctccaaaccactgcatgtttagcctgattcctccttggctggaccatctaagaaccctagaactctctaaccacatctagagccaaaataatgtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacag

SEQ ID NO: 193553 - DNA, 3480 bp, Homo sapiens
  Payload ID: 18213
  Gene Name: transmembrane protein 132A
  Uniprot ID: Q24JP5
  ENST ID: ENST00000005286
  CDS Start-End: 154-3228
gggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 193554 - DNA, 3346 bp, Homo sapiens
  Payload ID: 18213
  Gene Name: transmembrane protein 132A
  Uniprot ID: Q24JP5
  ENST ID: ENST00000453848
  CDS Start-End: 159-3230
tgtctgggaattgcagccgcggggcgggcggcggcggcggcggcggcggccgggacccagcgggccaggtggggacggcgcggagcgggtgcgggagatgccgtgcgggactggggccacctgagccgcccgcctcgtccccgccttctgtgggaaggatgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctg

SEQ ID NO: 193555 - DNA, 2013 bp, Homo sapiens
  Payload ID: 18213
  Gene Name: transmembrane protein 132A
  ENST ID: ENST00000540112
  CDS Start-End: 1-341
actggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggtgacagttggggggtcagggggatgaggtcaacatctccagatgggggctcatggtagaggggaatgggaggaagggaccctggtacctcgaccccttagggttttcagagtgaggactgactctgtgaggtagtgagctctctgcagctggaggtgatcaagcagtggctggagtatggcagtgggaggttggttagatggctctaactgaggaccctcccaataactcagaccctagggctgagtggcagacaggtgattgacacgcgtcccctctctccctgtgttttgtctatctgcctgtgtctctgttttctctctggtctctcctccatgtggcctatctctgtgggagtggtttctctgtgcatgcgtgcgtgccctcgcatgtctctgcctgtgtctgtgtgccccacaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaa

SEQ ID NO: 193556 - DNA, 692 bp, Homo sapiens
  Payload ID: 18213
  Gene Name: transmembrane protein 132A
  ENST ID: ENST00000535480
  CDS Start-End: 1-312
tcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtgcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctgaccctccacagccacctggtcagccaccagctggggcaacgagggtggaggtcccactgagcctctcgcctgcccccgccactcgtctggtgcttgttgatccaagtcccctgcctggtcccccacaaggactcccatccaggccccctctgccctgccccttgtcatggaccatggtcgtgaggaagggctcatgccccttatttatgggaaccatttcattctaacagaataaaccgagaaggaaaccaga

SEQ ID NO: 193557 - DNA, 454 bp, Homo sapiens
  Payload ID: 18213
  Gene Name: transmembrane protein 132A
  ENST ID: ENST00000536409
  CDS Start-End: 1-454
agcggtcactcgccccgtcacgtggcagctggagtacccaggccaggcccctgaagcagagaaggacaaaatggtgtgggaaatcctggtgtctgagcgggacatcagagcccttatcccactggccaaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggac

SEQ ID NO: 193558 - DNA, 990 bp, Homo sapiens
  Payload ID: 18213
  Gene Name: transmembrane protein 132A
  ENST ID: ENST00000544065
  CDS Start-End: 761-990
ctccattgtctgggaattgcagccgcggggcgggcggcggcggcggcggcggcggccgggacccagcgggccagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccag

SEQ ID NO: 193559 - DNA, 10906 bp, Homo sapiens
  Payload ID: 18214
  Gene Name: transmembrane protein 132B
  Uniprot ID: Q14DG7
  ENST ID: ENST00000299308
  CDS Start-End: 9-3245
tacgggaaatgtttggtgcagcatccagaatggacaccactgctgtctgcaccgggggagtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatggacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaaggtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacacttgccaagtgcctagaggggctagaggctctctgttggtgtgtgtgtatttcttgaaactgcagagtcatttttggcatgctggcaaatgctactccttgcttttaggatgaatagggatgcctctttggcgataatttgacgtgtcataataaatgcccaataccaaacctagtctttctccaggcccttcagacatcattcaggtaactgggtgtaaacacaggagttggctttgtgaaactgaggcaggatttcctgcctctaaactattggcagcaaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactctggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataacttttgacctgacacatctttctgtacttcctgtggccaaaaaagcaagtgagactttctgtttcccattgtaaggctggagctgaaatagtctgccacgttattgttatctcctttgtaagaatttgactttctgaatgaaataacagaatgccagtgtcaacactgaccatatgatatagttatttcacttagagatgcttcctcaaagagcgtgcctttttcctccatcataaccgctttaggatctctgttttatccatgtatttcccacatagtagaagcattttccatttccatgaatattacaggctgagaaggagcacacatctggcactgataagcacactggcccaggcactcagccttctcatttcattaatctggttggtgaccgtttccatcgggcacacctggaaatgtccatcggacatattgccatctcagttgctgcagtgcagtgaattaccccagagccaccagttcacatgcccaaagatgaactggcccatggagggacttgattgccaagtgacttcctttctgtagttatcctctgctgtgacccttattttggacttctagcaagggcattcagtgtggattccaagaacaaaaccaattgtccaacctccattacaggggtcttctaggtattccccacacattatttgtgggcataagcaaacaccataactatgaaaggctgagagtggagaattaagtcataaggaaatgatcaaacctagggaaaaataagtggctataaaacactgaaagatagtcacatccacatagcgtgtatcatgcaacagacccgtgctcttagagggaggtagtgtgtgtcttcccatggcaaataatttttacaatactgctcatgtttaatgtgtgtctacagggcatgctgttgtctcaaaattgaaatgtgcatcttaggtatcagttcccagcctcagactcttctcaggcaggtggaccggatctcagctgcagaacatagtgagtggccaaacctacacagcccagccagtagtgtgctttggggtgattgcaaggcagcaaacagtggggacaagttttgtctggcatttgaaaaggtgttatcccttactttccacatttctgaattggattcttgttccctggtaaacaccagatattataaacagagcatgctgttatgacattgtgcttctatatacctttttgtataatgtatctatctcattatattacctatggtttcagtatgatctgttgtgtatgttccaccgtatatttaatgtctctgtaaaggcacttccaaacattttgaaaacgaagaaataaaacatgttggatgatt

SEQ ID NO: 193560 - DNA, 9659 bp, Homo sapiens
  Payload ID: 18214
  Gene Name: transmembrane protein 132B
  Uniprot ID: Q14DG7
  ENST ID: ENST00000613307
  CDS Start-End: 220-1992
atagccaggtttccaaccaacctttcctgtgctggaaaggactcacagtcaagaaaggtgtagatcctgcagactgcgtggaggccatgctttcacatcaagccttcctcggtgacttgctcagcctgactgtgttcttatttgctgggtctctctctggaaatctccactttgagtgtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacacttgccaagtgcctagaggggctagaggctctctgttggtgtgtgtgtatttcttgaaactgcagagtcatttttggcatgctggcaaatgctactccttgcttttaggatgaatagggatgcctctttggcgataatttgacgtgtcataataaatgcccaataccaaacctagtctttctccaggcccttcagacatcattcaggtaactgggtgtaaacacaggagttggctttgtgaaactgaggcaggatttcctgcctctaaactattggcagcaaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactctggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataacttttgacctgacacatctttctgtacttcctgtggccaaaaaagcaagtgagactttctgtttcccattgtaaggctggagctgaaatagtctgccacgttattgttatctcctttgtaagaatttgactttctgaatgaaataacagaatgccagtgtcaacactgaccatatgatatagttatttcacttagagatgcttcctcaaagagcgtgcctttttcctccatcataaccgctttaggatctctgttttatccatgtatttcccacatagtagaagcattttccatttccatgaatattacaggctgagaaggagcacacatctggcactgataagcacactggcccaggcactcagccttctcatttcattaatctggttggtgaccgtttccatcgggcacacctggaaatgtccatcggacatattgccatctcagttgctgcagtgcagtgaattaccccagagccaccagttcacatgcccaaagatgaactggcccatggagggacttgattgccaagtgacttcctttctgtagttatcctctgctgtgacccttattttggacttctagcaagggcattcagtgtggattccaagaacaaaaccaattgtccaacctccattacaggggtcttctaggtattccccacacattatttgtgggcataagcaaacaccataactatgaaaggctgagagtggagaattaagtcataaggaaatgatcaaacctagggaaaaataagtggctataaaacactgaaagatagtcacatccacatagcgtgtatcatgcaacagacccgtgctcttagagggaggtagtgtgtgtcttcccatggcaaataatttttacaatactgctcatgtttaatgtgtgtctacagggcatgctgttgtctcaaaattgaaatgtgcatcttaggtatcagttcccagcctcagactcttctcaggcaggtggaccggatctcagctgcagaacatagtgagtggccaaacctacacagcccagccagtagtgtgctttggggtgattgcaaggcagcaaacagtggggacaagttttgtctggcatttgaaaaggtgttatcccttactttccacatttctgaattggattcttgttccctggtaaacaccagatattataaacagagcatgctgttatgacattgtgcttctatatacctttttgtataatgtatctatctcattatattacctatggtttcagtatgatctgttgtgtatgttccaccgtatatttaatgtctctgtaaaggcacttccaaacattttgaaaacgaagaaataaaacatgttggatgattccttgt

SEQ ID NO: 193561 - DNA, 4947 bp, Homo sapiens
  Payload ID: 18215
  Gene Name: transmembrane protein 132C
  Uniprot ID: Q8N3T6
  ENST ID: ENST00000435159
  CDS Start-End: 1-3327
atgcgctccgagggtgcggcccccgggccggcggcgccgctgtgcggggcgctgagcctgctgctgggcgcgctgctgggcaaagtgatagagggtcacggggtcacagacaacatacagagattctcctcactgccaccttacctacctgtgagctaccacatcctcagagcagagacctccttcttcctcaaggaagccaaccaggacctgctgcggaactccagcctgcaggcgagggtggagtccttctttacctacaaaaccaggcagcccccagtgctcaatgccagctatggacccttttctgtggagaaggttgtgcctctggacttgatgttgacttcaaactttttaggtccaaccaataagtttagttttgattggaaactaaaagcccacatcctgcgggacaaagtctacctgagccggcccaaagtgcaggttcttttccacatcatgggcagagactgggatgaccacggcgccggggagaagctgccatgcctgagggtctttgctttccgagaaaccagagaggtgcggggcagctgccggctgaagggggacctggggctgtgtgtggctgagctggagctcctgtccagctggttcagtgccccgacggtgggtgccgggaggaagaagtccatggaccagccggaggggacccctgtggagctctactacaccgtgcacccaggaaacgagcgaggggactgtgccgggggtgacttcaggaagggcaacgccatccgtccaggaaaggatgggctggaggaaaccacgtcccacctgcagaggatcggcaccgtcggcctttaccgggcccaggacagcgcccagctcagcgagctgcgtttggatggtaacgtggtcatctggctgccttccaggccagtcaagcagggagaggtggtcacggcctatgtcaccatctcgagcaattcctctgtggacctcttcatcttgagagccaaggtgaagaagggggtgaacatcctgagtgctcagacccgtgagccccggcagtggggcgtcaagcaggaggtgggcagcggcggaaagcacgtgacggccaccgtggcctgccagcgcctggggcccagcccacgcaacaggagcagcagtttattcaatgaggttgtgcagatgaactttgaaatagccagtttcagcagcctttcagggactcagcccatcacgtggcaggtggagtacccacggaaggggaccacagacatcgccgtgtccgagatctttgtcagccagaaggacctggtgggcatcgttcccttggctatggacactgaaattctgaacaccgccgtactcacaggaaagacagttgccatgcctatcaaggtggtctctgtggaggagaacagtgccgtgatggacatctcagagtcggtggagtgcaagtccacagacgaggacgttatcaaagtgtctgagcgctgtgactacatctttgtcaatggcaaagagatcaaaggaaagatggatgcggtggtgaacttcacataccagtacctgagcgcccccctgtgtgtcaccgtgtgggtgccccggctgcccctgcagatcgaggtctctgacacggagctcagccagataaagggctggagggtccccattgtgaccaataagaggcccactcgtgagagcgaggatgaggacgaggaggagcggcggggccggggctgcgcactgcaataccagcacgccaccgtgcgggtcctcacccagtttgtgtctgagggcgccggtccatggggccagccgaactacctgcttagtcctaactggcagttcgacatcactcacctggtggcagacttcatgaagctggaggaacctcacgtggccaccctccaggacagccgggtcctggttgggcgagaggttgggatgacgaccatccaggtgttgtctccactgtctgactccatcctggcagagaagacaataaccgtgctagatgacaaagtatcggtgacagacttggccatccagctcgtggctgggctgtctgtcgccctttaccccaacgcagaaaacagcaaggccgtaacagctgtggtcacagctgaggaggtgctgcggacccccaaacaggaggctgtattcagcacgtggctgcagttcagtgatggctctgtgacgcccctggacatctacgacaccaaggacttctccctggcagccacctcccaggacgaggctgtcgtgtcagtcccccagccccgctctcccaggtggcccgttgtggtggccgaaggggaaggccagggcccactgatccgagtggacatgacgatcgccgaggcctgccagaaatctaaacgcaagagcatcctggctgtgggcgtcggcaacgtcagggtcaagttcggacagaacgatgctgactccagccccggcggggactatgaggaagatgagatcaagaaccacgccagcgaccgccggcagaagggccagcaccatgagcgcacaggccaagatgggcacctctatggcagctctcccgtggagcgtgaggaaggggctctccgaagagccactaccacggccaggtccctgctggacaacaaagtggtgaagaacagtcgggcagacgggggcaggctggcaggagaggggcagctgcagaacatccccattgacttcaccaacttccctgcccacgtggacctccccaaggccgggagtgggctggaggaaaacgacctggtgcagactccgcggggcctgagtgatctggagatagggatgtacgccctcctgggggtgttctgcctggccatcctcgtcttcctgatcaactgcgccacctttgccctgaagtacaggcacaagcaagtgcccctggaaggtcaggcctccatgacccactctcacgactgggtgtggcttggcaatgaggccgaactcctggagagcatgggggatgcgccgccgccccaggacgagcacaccaccatcatagaccgcggaccgggggcctgcgaggagagcaaccatctcctgctcaatggtggctcccacaagcacgtgcagagccagattcacaggtcagccgactccggggggcggcagggcagagaacagaagcaggaccccctgcactcgcccacctccaagaggaagaaggtgaaatttaccacctttaccaccatccccccggacgacagctgccccacggtgaactccatcgtcagcagcaatgatgaggacatcaaatgggtgtgtcaagacgtggctgtgggtgcccccaaggaacttagaaactatctggagaaactcaaagataaggcttaggcccctctagccaaagggccctgcccagatgccttccttgtactggaaactggcccaagtggggcagaaggcgttgtcagtggggttaagaagggacggtcccagggtccatgctagaccagttggaaagttttgaagtcaggaaaagacgtttttgtatcaagggatttttagcagttaatggtggtggatttttaaaggtcaggggaataaagtctggggcatggggagtgcagaccaagttactgaactgcacaggcaaaattaggaaggttattttatgagtcaaaacatactacagacaagctaccaaaaattatttgttaaaaaatgcaacaagacaaataaaaagagaaataatcatctgtttatatttctaataaaggagcaaaatataaaaataggacctgctaagagacattttccattctaattcacgattcacttttccaaggacagccttcaactgtcaccacacagctgggggggagtcatttcttaacaagggatgcctcttgggatagaactagggagttttaaatctttacttgatcatcttttattttcttttccactttttccttttttctctctctctgtgtcctagacttccattgcatttatatttaatgtttatttctgagaatcaagcagtatatttttcctaaatgaaacataaattatattcctattcattagataggttcctaggaacaatgccaattaatccattgtttaagtagtaacttgaatgtttttctatatccctccagctttgttgatagtggcgggttttgtacaattggagggagccctcagagccttctgggggaggagaggaactgtccttaatccatcaccactaccatagggcaaagccagcaggtgtggccctgtgaggggctgtacagacgggatgtggccaggagaacagagccccacctggaccacctgacccctcgggattccacccctgtcatcgtggggatgttcctatatgggagaaagttgggttaaatcaaaaaagaggccacgcccaggtgtaatcagagccaacctggtgggcttggtctatcacaagacataactgatgctgaacatgaacaaagataaaaactgtttggagggtttttgagttgtttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgccagtgaaataagccccttcgtgatcacctgactccagttctccgtgtgctccattggctgcggctgcaggaggaagatgcctgacagccctcatgctctccgcaggggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatatttatttatacctgtgatgccaattgtcattaaaaggcttttcatggcttgacaagtca

SEQ ID NO: 193562 - DNA, 5305 bp, Homo sapiens
  Payload ID: 18216
  Gene Name: transmembrane protein 132D
  Uniprot ID: Q14C87
  ENST ID: ENST00000389441
  CDS Start-End: 1242-3155
cgtttatagataccaaggatgaggatgtggatacctttcggagctattatttagtctcccacactctcccgaagacatgtcccaattcttgtttaggatgaaaactaaaggactcattgccttcccccaggaaagctaggagacaagacaagagaacaaaatccttacattgaacttgcttcttcccatcagcgctggcatggaggagccctcttgcaccaggtagaagttggcagcctgagctctggagccagacttctggggctaaatcctggctctgcccttcctggtagaggaacataggcaggctcccccactcctgccggcttcctcatctggaatgtgggaatggcagtggtgcctagcgttgtggttgttctgaggatgaaaggaatccgcatgtttggattccctgaaaagcggagcctgtgacgtgcacttgagaacaggtgctttatttggggaatgatctctggaggcagaatgagggagtgagcagcaagacaggacacattttggaaaaccagcaggaggtgcatcattgagctagctcgcatggtgggcaacttctgtgaagtcccatcgagcccctctagggaattctgcaggacaggcctcagaatccacccctgtgcctcgtcgagcccctctagggaactctgcaggacgggcctcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagtccaccaacctagccacagggaccccaggaagcctgggtactcagagagcacctttcataacagcgtctgctattattactcaaaagcaacacccaatgtctgctccataccaggacctcctcccccatagtaaggggaggaaagggaagcacctccaccagccagggcacttccctttcctcctccttgggccatgcaacgggatgaaagctcacctttccctccccttttctctctcacctcttcacaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggct

SEQ ID NO: 193563 - DNA, 5776 bp, Homo sapiens
  Payload ID: 18216
  Gene Name: transmembrane protein 132D
  Uniprot ID: Q14C87
  ENST ID: ENST00000422113
  CDS Start-End: 328-3627
ccactcttcgctcgggtaaacaggaaaggaaataccccctgtggattaaaatttaaaaaaaattctgttggggtcgaaggagggaggtggggtttgcctgcgcgcgtgttggactccggagagcaactcaggagcccgcgcggtcgtcgcctcccggcctggccatggactggcgggaagagggagcagggcgcccgggctgctcgggcccctagccgggcgctccctcgccaccggccccgctgcgggcctctaggggactgagacggtctcttgttcgcctggacggcgccggggagcggaggatctgcgctccgggtctccaggatgtgcccgtctgagatggggacgctgtggcaccactggtcgccggtactcatcagcctggccgccctgttttccaaagtgacggaaggtcgagggatccttgagagcatccagaggttttccttgctgcccacctacctccccgtgacctaccacatcaacaacgcggacgtctccttcttcctgaaggaggccaaccaggatatcatgaggaactccagcctgcagtcccgggtggagtcatttctgatttacaaatccaggaggctgcctgtcctcaatgccagctacgggcctttctccatcgagcaagtggtgccccaggatttaatgctaccttccaacccatttggattcaccaacaaattttctcttaactggaaactaaaagcccacatcctgcgggacaaagtctacctgagccggcccaaagtgcaggttctgttccacatcatgggcagagactgggacgaccgcagcgccggggagaagctgccgtgcctgagggtctttgctttccgagagacccgagaggtgcggggcagctgccggctgcagggggacctggggctgtgcgtggccgagctggagctcctgtccagctggttcagcccccccacggtggttgccgggaggaggaagtccgtggaccagccggaggggacccccgtggagctctactacaccgtgcacccagggggtgagagaggggactgcgtcagggaagacgcgaggagaagcaatgggatccggacaggccacagtgacatcgatgagtccgggccccccttgcagaggatcgggagcatcttcctttatcagacacacaggaaaccctccctgagagaactgcgtctggacaacagcgtggccatccactatataccaaagaccgtgaggaaaggagacgtgctgacttttcctgtttccatctccagaaattccactgaagatcgcttcacgttgagggcaaaggtgaagaaaggcgtgaacatcatcggcgtgcgagccagcagcccttccatttgggatgtcaaggagcgcacggattatactggaaagtatgcaccagctgtcatcgtttgtcagaagaaagcagctggctcagaaaacagtgcggatggcgcctcctacgaggtcatgcagatcgatgtggaggtggaagagcctggtgacctgccagccacacagctggtcacgtggcaggtcgagtaccccggagagatcacgtctgacttgggagtgtccaagatctatgtgagcccaaaggacttgattggagttgtgccgctggctatggaggcagaaatcctgaacacagccatcctcacggggaagacggtggccgtcccggtgaaagtggtctccgtggaggacgacggcacagtgacagagctgctggagtctgtggagtgtagatcgtctgatgaagacgtgattaaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggc

SEQ ID NO: 193564 - DNA, 5389 bp, Homo sapiens
  Payload ID: 18216
  Gene Name: transmembrane protein 132D
  ENST ID: ENST00000619366
  CDS Start-End: 1-3240
gcactgcgattccccacagtgacggaaggtcgagggatccttgagagcatccagaggttttccttgctgcccacctacctccccgtgacctaccacatcaacaacgcggacgtctccttcttcctgaaggaggccaaccaggatatcatgaggaactccagcctgcagtcccgggtggagtcatttctgatttacaaatccaggaggctgcctgtcctcaatgccagctacgggcctttctccatcgagcaagtggtgccccaggatttaatgctaccttccaacccatttggattcaccaacaaattttctcttaactggaaactaaaagcccacatcctgcgggacaaagtctacctgagccggcccaaagtgcaggttctgttccacatcatgggcagagactgggacgaccgcagcgccggggagaagctgccgtgcctgagggtctttgctttccgagagacccgagaggtgcggggcagctgccggctgcagggggacctggggctgtgcgtggccgagctggagctcctgtccagctggttcagcccccccacggtggttgccgggaggaggaagtccgtggaccagccggaggggacccccgtggagctctactacaccgtgcacccagggggtgagagaggggactgcgtcagggaagacgcgaggagaagcaatgggatccggacaggccacagtgacatcgatgagtccgggccccccttgcagaggatcgggagcatcttcctttatcagacacacaggaaaccctccctgagagaactgcgtctggacaacagcgtggccatccactatataccaaagaccgtgaggaaaggagacgtgctgacttttcctgtttccatctccagaaattccactgaagatcgcttcacgttgagggcaaaggtgaagaaaggcgtgaacatcatcggcgtgcgagccagcagcccttccatttgggatgtcaaggagcgcacggattatactggaaagtatgcaccagctgtcatcgtttgtcagaagaaagcagctggctcagaaaacagtgcggatggcgcctcctacgaggtcatgcagatcgatgtggaggtggaagagcctggtgacctgccagccacacagctggtcacgtggcaggtcgagtaccccggagagatcacgtctgacttgggagtgtccaagatctatgtgagcccaaaggacttgattggagttgtgccgctggctatggaggcagaaatcctgaacacagccatcctcacggggaagacggtggccgtcccggtgaaagtggtctccgtggaggacgacggcacagtgacagagctgctggagtctgtggagtgtagatcgtctgatgaagacgtgattaaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggc

SEQ ID NO: 193565 - DNA, 4369 bp, Homo sapiens
  Payload ID: 18217
  Gene Name: transmembrane protein 132E
  Uniprot ID: Q6IEE7
  ENST ID: ENST00000321639
  CDS Start-End: 329-3283
cccccgggacgcccgcggccaccgggctccggactgcacgtgcagctccccccgcgcctcgcagatcctgcagggggcaccagctgggggaggtggaggctcctcccgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcagcgctactcgcccacgcctctggccgctcccacccggccagccccagcccgccggggccgcaggccagcccggtgctgccagtcagctaccgcctgtcgcacacgcggctggccttcttcctgcgggaggcgcggcccccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtccgctcgcacgtgcccgcctcgcagcccgtggtccaggtgctgttctacgtagccggccgggactgggacgacttcggcgtcaccgagcggctgccctgtgtccgcctgcatgccttccgggatgcccgggaacaccccctgctgcgcatcgggagcatcagcctgttccgcccgccccccaggaggaccctgcaggagcacaggctggacagcaacctgatgatccgcctgccagaccggcccctcaagcccggggaagtgctcagcatcctcctctatctggcccccaactcctcctcgccctccagccccagcgtggagcacttcacactcagggtgaaggccaagaagggtgtgacccttttaggtaccaagtcacggagtggccagtggcatgtgacctcggagctgctgactggggcaaagcactcaacagccaccgtggatgtggcctgggctcagagcacacccctgccccccagggagggccagggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgcaagccatcctgcccctggccatggacacagagatcatcaacacggccattctgactggccggacagtggccatccctgtcaaggtcattgccatcgaggtgaatggcctcgtcctggacatctccgccctagtggaatgcgagtctgacaatgaagacatcatcaaggtatccagcagctgtgactacgtgtttgtgagtggaaaagagtctcgagggtccatgaacgccagggtcaccttccgctacgacgtcctcaatgctcccctggaaatgacagtctgggtccccaagctgcccttgcacattgagctctcagatgcccgcctcagccaagtgaagggctggagggtacctatcctccccgaccggaggtcagtccgggaaagcgaggatgaggatgaggaggaggaggagcggcggcagagtgcaagccgtggctgcaccctgcagtaccagcatgccaccctgcaggtcttcacccagttccacacgacatcatccgagggcactgaccaggtggtcaccatgttaggcccggactggctggtggaggtcaccgacctagtcagtgacttcatgcgggtgggcgatccccgagtggcacacatggtggacagcagcacgctggcaggactggagccaggcaccaccccctttaaggtggtgtctccgctgacggaggctgtgctcggggagacgctgctgacggtgactgaggagaaggtcagcatcacacagcttcaggcccaggtggtggccagcctggccctctccctgcggcccagccctgggagcagccacaccatcctagccaccacagctgcccaacagaccttgagcttcctcaagcaggaagccctactgagcctctggctctcctacagtgatggcaccacagccccactctccctctacagcccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggcgggggcgaggacgaggcccggggagctggcccgccgggctctgcgctacccgcaccggaggctccaggcccgggcaccgccagccccgtcgtgccacccacagaagacttcctgccgctgcccaccggcttcctgcaggtgccacggggtctgacagacctggagatcggcatgtacgcgctgctgggcgtcttctgcctcgccatcctcgtcttcctcatcaactgcatcgtttttgtgctgcgctaccggcacaagcgcatcccgcccgagggccagaccagcatggaccactctcaccactgggtgttcctgggcaacgggcagccgctgcgggtgcaaggagagctgtcgccgccagcaggcaacccgctggaaaccgtgcccgccttctgccacggcgaccaccacagcagcggcagctcgcagaccagcgtccagagccaggtgcacggcaggggcgacggctcctcgggcggctcagcccgagaccaagccgaggaccccgccagctcgcccacctccaagcgcaagcgggtcaagttcaccaccttcaccacgctgccgtcagaggagctggcctatgactcggtgcccgcgggcgaagaggacgaggaggaggaagaggacctgggttggggctgcccggatgtggcgggccccacgcggcccactgcacccccggacctgcacaattacatgcgcagaatcaaagagattgcatagaggcgccagccggagtagcagggacccccccccccaacggggtcagctcggggtaggacacagccgggaccccggttcacactgactctgggcggctgaattgattttgtactccctgcccctgcagcttggctccgtgcggagcgggccgcctcagtgtctgggccttccctcgcctcacgccattaccctcttctgccccctgcaggtggagggctcttcctccagtggctcgtaaggaggaaagcaaccccagcctctgttctgccctttccaaacctcctcccatcttaagcaaccccctgccccaagagtgaggcaaggaggtccagcttggggtcaggtgggcccacgctgtgtcccgggcccgcctcccgtcccccgtgtcgtccccctgtgcagggggttctgtgggggtcttgtgtcacaggctgcacaaagactttcctcaaactaatattcagggatttctgtcctgcagggtggggaggtggcagctgcctgccctgccaaggatcttgctgtggacgaaatatctgggggttagggggacagttgtagcatctgctggcattcgggtgcctcccaggacctgggagctgactctacagagaggtctggtgccaagccaggcaccttcctgagttctcaggactcccacctctgccccaagggctttgggcagggacctaaaggggaaagagtcctggatccatctctagccaaatcacaccccagagccagaggcctggggacctccttgccttccccgtcccccacagcaaggtcaacactactacgccttagccacccgtcaccctgctgactgcgacttccctctgcagcacagggcaggcagccacctatgccccacaagacggaacccgggaggggagtagagggcaccagggaatgctgtgagggacttcagggtgggcaaatgcagaagggagccagtgtcgcccctaccccatcccacagccatttttctctcgggttctacccaccactgtgtcggatttttcttaaataaatggaagcggtcagactggaggtgggggcagcagctcccatgaacagagagta

SEQ ID NO: 193566 - DNA, 4379 bp, Homo sapiens
  Payload ID: 18217
  Gene Name: transmembrane protein 132E
  ENST ID: ENST00000631683
  CDS Start-End: 69-3293
agcccagcctggggccaagtcgtcgtcgactgttgctctctcggacccctcccgcccccgcctcggccatggccccggggatgtcgggccgcggcggcgccgccctgctctgcctctcagcgctactcgcccacgcctctggccgctcccacccggccagccccagcccgccggggccgcaggccagcccggtgctgccagtcagctaccgcctgtcgcacacgcggctggccttcttcctgcgggaggcgcggcccccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtccgctcgcacgtgcccgcctcgcagcccgtggtccaggtgctgttctacgtagccggccgggactgggacgacttcggcgtcaccgagcggctgccctgtgtccgcctgcatgccttccgggatgcccgggaagtcaagagctcctgccgcctcagcgggggcctggccacttgtctggtgcgggcagagctgcccctggcctggttcgggcccccagcccccgctgcgccacccacggcccgccgcaagtccccggacgggctggagcccgaggcgacgggggagagccagcaggccgagctctactacacgctccacgcccctgatgcgtcggggggctgcgggggctcccgccggggggccgggcccggggtgggggcccgagcggaaagccctacccagcaccccctgctgcgcatcgggagcatcagcctgttccgcccgccccccaggaggaccctgcaggagcacaggctggacagcaacctgatgatccgcctgccagaccggcccctcaagcccggggaagtgctcagcatcctcctctatctggcccccaactcctcctcgccctccagccccagcgtggagcacttcacactcagggtgaaggccaagaagggtgtgacccttttaggtaccaagtcacggagtggccagtggcatgtgacctcggagctgctgactggggcaaagcactcaacagccaccgtggatgtggcctgggctcagagcacacccctgccccccagggagggccagggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgcaagccatcctgcccctggccatggacacagagatcatcaacacggccattctgactggccggacagtggccatccctgtcaaggtcattgccatcgaggtgaatggcctcgtcctggacatctccgccctagtggaatgcgagtctgacaatgaagacatcatcaaggtatccagcagctgtgactacgtgtttgtgagtggaaaagagtctcgagggtccatgaacgccagggtcaccttccgctacgacgtcctcaatgctcccctggaaatgacagtctgggtccccaagctgcccttgcacattgagctctcagatgcccgcctcagccaagtgaagggctggagggtacctatcctccccgaccggaggtcagtccgggaaagcgaggatgaggatgaggaggaggaggagcggcggcagagtgcaagccgtggctgcaccctgcagtaccagcatgccaccctgcaggtcttcacccagttccacacgacatcatccgagggcactgaccaggtggtcaccatgttaggcccggactggctggtggaggtcaccgacctagtcagtgacttcatgcgggtgggcgatccccgagtggcacacatggtggacagcagcacgctggcaggactggagccaggcaccaccccctttaaggtggtgtctccgctgacggaggctgtgctcggggagacgctgctgacggtgactgaggagaaggtcagcatcacacagcttcaggcccaggtggtggccagcctggccctctccctgcggcccagccctgggagcagccacaccatcctagccaccacagctgcccaacagaccttgagcttcctcaagcaggaagccctactgagcctctggctctcctacagtgatggcaccacagccccactctccctctacagcccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggcgggggcgaggacgaggcccggggagctggcccgccgggctctgcgctacccgcaccggaggctccaggcccgggcaccgccagccccgtcgtgccacccacagaagacttcctgccgctgcccaccggcttcctgcaggtgccacggggtctgacagacctggagatcggcatgtacgcgctgctgggcgtcttctgcctcgccatcctcgtcttcctcatcaactgcatcgtttttgtgctgcgctaccggcacaagcgcatcccgcccgagggccagaccagcatggaccactctcaccactgggtgttcctgggcaacgggcagccgctgcgggtgcaaggagagctgtcgccgccagcaggcaacccgctggaaaccgtgcccgccttctgccacggcgaccaccacagcagcggcagctcgcagaccagcgtccagagccaggtgcacggcaggggcgacggctcctcgggcggctcagcccgagaccaagccgaggaccccgccagctcgcccacctccaagcgcaagcgggtcaagttcaccaccttcaccacgctgccgtcagaggagctggcctatgactcggtgcccgcgggcgaagaggacgaggaggaggaagaggacctgggttggggctgcccggatgtggcgggccccacgcggcccactgcacccccggacctgcacaattacatgcgcagaatcaaagagattgcatagaggcgccagccggagtagcagggacccccccccccaacggggtcagctcggggtaggacacagccgggaccccggttcacactgactctgggcggctgaattgattttgtactccctgcccctgcagcttggctccgtgcggagcgggccgcctcagtgtctgggccttccctcgcctcacgccattaccctcttctgccccctgcaggtggagggctcttcctccagtggctcgtaaggaggaaagcaaccccagcctctgttctgccctttccaaacctcctcccatcttaagcaaccccctgccccaagagtgaggcaaggaggtccagcttggggtcaggtgggcccacgctgtgtcccgggcccgcctcccgtcccccgtgtcgtccccctgtgcagggggttctgtgggggtcttgtgtcacaggctgcacaaagactttcctcaaactaatattcagggatttctgtcctgcagggtggggaggtggcagctgcctgccctgccaaggatcttgctgtggacgaaatatctgggggttagggggacagttgtagcatctgctggcattcgggtgcctcccaggacctgggagctgactctacagagaggtctggtgccaagccaggcaccttcctgagttctcaggactcccacctctgccccaagggctttgggcagggacctaaaggggaaagagtcctggatccatctctagccaaatcacaccccagagccagaggcctggggacctccttgccttccccgtcccccacagcaaggtcaacactactacgccttagccacccgtcaccctgctgactgcgacttccctctgcagcacagggcaggcagccacctatgccccacaagacggaacccgggaggggagtagagggcaccagggaatgctgtgagggacttcagggtgggcaaatgcagaagggagccagtgtcgcccctaccccatcccacagccatttttctctcgggttctacccaccactgtgtcggatttttcttaaataaatggaagcggtcagactggaggtgggggcagcagctcccatgaacagagagta

SEQ ID NO: 193567 - DNA, 1953 bp, Homo sapiens
  Payload ID: 18218
  Gene Name: transmembrane protein 133
  Uniprot ID: Q9H2Q1
  ENST ID: ENST00000303130
  CDS Start-End: 321-710
ttcactatgttgtgaggcaaacagatttctcactatcatccagtgtaccctgctcaccttctcactcctagcaccgttcttctggtctgtgttgaaaagggtatcattcatgtggtttcagtttagaagagtccctcagagctttgcctcaagcaatttcaaattgtagtgataccttaaatcatgtattcaggatgccttctttagcatttagaaccccaactagacttatactttgactaaagtcagaggcagaccaatttagggaacagattttgttctttgcttttatgatacatttgtaactcacagctgttagcatgacctcacatcactgcgtaggacccggaaatcacatctcctggtcaggtcacgaaaaagaacacaggcttgactattgtccagaagttactttccccttgactaaaggtttccccttagggtacacattgctatttaactttgcctcctacccttttttgttaccttccaaaatcaagacacttttaagaaacaaagatagttttctgaacattctgtgtcctgcctgtctcctgttgattcgcagatgtaatatcgagtattcatcaactggtctcaatttcctgaacacattcactgtatccctcattgtcaccgttatccccctgcttcaaaatgtgccagttccacttggtaataacgttgggaaaatgcaggtttatgaatgatgtggacttttagaggatcaaatcaataaattggattttttattttttgagggcagctgccctcactgttttaaataaagaatcttacataagaatgttgacaacattcacagtaagccattggcagaaaattgatctgcatgtcctagaccaatgattacaaggtgtctgtggtttagggggcccagcccatcattccttttccccttggcactcatgagagagatgccaagttcagtgtggatttttcttggtgctctatggagaaatggagtctgtgtgcttactgaagagtcccaaaaaccagagaccattttcatttactgccatcataaatattctccaccattcaagatgcctgtgtacacggctatttgggaaacttaagtgttggaggaggcaggggctgaaggtgtcaaaacctcctcagtaggataacccctttctcccctttggaccatctgccatctttcatgagtgtttcccatggtgtttttgcatccagagttgacaacaactcaattttgccttgaatttactcagtcttataaattaaaaatgtgcattttatataaagatgcattttatataaaaatgcacacctttaatctctatatggcagcatatacatatatatatataaaatgcacacttttaatctctatatggcagcatttttgaggctttatatctgcccgtgtaccctcaactgcctcctttttgcagagaacgatccccacaggaactggtctaagaacactgtctgcacatgattgatgcttaaaatccaatataccaccacatatcaaaggttgggattttcagagtccttcttgatttctgagctgaaaccttaacaaatagggaatttggcagggaagacacctgggtttttaattcagaaccctatttatatactgttaaaatttgaggtactgtagtttatataaaagtcggatgttaagatattatatttcagtactaggagcttctttgcagtcattaacatgacaaattaagtaataaatataaaagtgattgtccataaattatcattgaattttttgtttattttgtagtgttctgtatttatctgcactttgtgtatatatacacacatacatatgccaacatgtaaataacctcatgtttattcctaatctaaattgccacaatatttttaatgtatggttacactgtgttttaaattactttaaaaataaactttgtaagcagattttaa

SEQ ID NO: 193568 - DNA, 3534 bp, Homo sapiens
  Payload ID: 18219
  Gene Name: transmembrane protein 134
  Uniprot ID: Q9H6X4
  ENST ID: ENST00000308022
  CDS Start-End: 43-630
cgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaccagaggcaattgctctcctcctgtcctgccactgctagcccagcccaccagcctgaccacagcccccctcccaaggactgaccctgacgctgaagggcttcgagcaccaccgaacgcgtggcagccctgatgctgaggcttgcccaagggcacggggcatgttaggggcagagctgggcgtaggactcctgccttgccagccaggagccggccggaacagcctgccccacccccagcccttggatgactcaaccagcccgtctctgtctggtggccctggccgagggcacgcagagatgacgcaggcctgggacctggaggctggtatcctagttccagcctggctctggggccctgggctgccacagccagccctgaatgtgggccatgtcaaggcaatggcccagccccctccacccactgccctccttcccagtcccagaggttgggagaacctgggggcagagggcataggaagccgcgcctgacagacaccctcagtggtcaaagacttagaaatgcagaacgttagaaacaaaccatctcagaattttggaacatcagcatttcagaatcttacgaaacaagaaacagaatctttgagaaacctgaaatctgagatcatagtagctaccagttatcaatttgttgaaagaccccaggatggccgggcacggtggctcaagcctgtaatcctagcactttgagaggccaaggtgggaggatcgcttgagcccaggagttcgcgaccaacctggacaacatggcgagaacccatctctatttaaaaaaaaaaaaagaaaagaaaatatactaggccctgcgctaagcactgaacacgggttatatcttgtaatcttcactacctccgtcccattttacagataaggactgactcacccaaggacagccagcaggtggtaggtagaattaggaacgtagcccagggctcttcccatgacactgtcggggagggagaaggaaaccggcactgagctggtctcccctaccggccaaccaagaggctggctgagtgagcaagggttgggaggccctgttggtgcacctgcccgtactgtctatctcccccaccaaaacacgggtcccacaaaccactgtctgcagcacccaacacagcggggccttcaggattctgagttagaggaatggacacccagactcttgctctcgctcccacctttccaggccccgcagacttcccaccctcatcccccattcaaggcacttagggggcacccattggatgcaggaactcctaaaccagtggtcccccaactagctatggtaaaggaccagttttcatttctaatccatcacggtccagtactttcataagaagaactagccgggtgccgtgcctcatgcctgtaatcccagcactttgagaggccacggtgggaggatcacttgagcccaggagttcgagaccaacctgggaaacatgggaaaaccccatctctacaaaaaatacaaaaacttagccaggcatggtggggcgcctgtagtcccacccacttgcgaggctggagtgggaggatcacggagcctgggaggctgcagtggagtcatgattgcaccactgcactccagcctggaagacagactgagacctatttaaaaaataaataaataaataacataaaaattttaaaaactagaaaaatgaaataaaaaacatacagaggctgggcgtggtggctcatgcctgcaatcccagcactttgggaggccgaggcaggtgaatcatgaggtcaggagttcgagaccagcctggccaacagggtgaaatcccatttctattaaaaatacaaaaaaattaccgggcatggtggtgcgcacctgtaatcccagctactcaggaggctgaggcaggagaatcgcttgaacccgggaggcagaggttgcagtgagccgagatcacgccactacactccagcctgagcgacagagcgagactctgtctccaaaaaaaaaaaaaatacagaatacaagtccacagtttatcagattaattagacataaaattacatttcaataaatataatcagaacaaacataggaaaaaggaaaaatgacaaaaaccattgaatatgaacaaacaggcaattaacacagaatcgcagctaacaactttttactccttgttttttttttttttgttttttttttgagacgagtctcactgtctcccaggctggagtgcagtggcccgatctcggctcactgcatcctctgcctcccggtttaagcgattctcatgcctcagccttctcagtagctgcgactacaggcacatgccaccatgcccagctaatctttgtatttttagtagagacagggtttcactatgttggccaggctggtctccaacccctgagccacctcgcccgacttcattctacagtcttaacagaaagcaatttcagaagtggtgattcccatcattagaagtctgcgttaggaatcagcaaggtatagtccacagagtggtttttatattttgtaatggttggagaaaagtcaaagaataataagattttatgacataaaattatataaaattcaaatttccatgtcaataaatgaagttttactgttatttattaaaatttctgatatagccaca

SEQ ID NO: 193569 - DNA, 823 bp, Homo sapiens
  Payload ID: 18219
  Gene Name: transmembrane protein 134
  Uniprot ID: Q9H6X4
  ENST ID: ENST00000393877
  CDS Start-End: 59-601
acgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctg

SEQ ID NO: 193570 - DNA, 1063 bp, Homo sapiens
  Payload ID: 18219
  Gene Name: transmembrane protein 134
  Uniprot ID: Q9H6X4
  ENST ID: ENST00000545682
  CDS Start-End: 48-626
gtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattccaccaga

SEQ ID NO: 193571 - DNA, 680 bp, Homo sapiens
  Payload ID: 18219
  Gene Name: transmembrane protein 134
  ENST ID: ENST00000536020
  CDS Start-End: 77-409
gggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccaggttagggccagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaa

SEQ ID NO: 193572 - DNA, 575 bp, Homo sapiens
  Payload ID: 18219
  Gene Name: transmembrane protein 134
  ENST ID: ENST00000540133
  CDS Start-End: 42-401
gcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccaggttagggccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgaggagacagaggccttgtgacctgggcacacagccaggaaatcacacatagctgaaaatggaacctggcttatcactgcaaagacttttccttttttaaaaaatttaacctgtt

SEQ ID NO: 193573 - DNA, 551 bp, Homo sapiens
  Payload ID: 18219
  Gene Name: transmembrane protein 134
  ENST ID: ENST00000535813
  CDS Start-End: 1-295
ggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattcca

SEQ ID NO: 193574 - DNA, 716 bp, Homo sapiens
  Payload ID: 18219
  Gene Name: transmembrane protein 134
  ENST ID: ENST00000541059
  CDS Start-End: 1-125
gcagcacccagcgctcctacaacacctgctgcagctggacccaacaccctttgatccagaagaaccgccgagtggtgctggcctccttcctgctcctgctgctggggctgggtgagtggccctgagggttggggtcaagaggggccccgtgggaggctctgccctccttttgtacaggctctgcctcccccttgacactgagcctcccagcatcctgaggaggcagctggctgccatcatcacactcccattttacagggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagccc

SEQ ID NO: 193575 - DNA, 2433 bp, Homo sapiens
  Payload ID: 18220
  Gene Name: transmembrane protein 135
  Uniprot ID: Q86UB9
  ENST ID: ENST00000305494
  CDS Start-End: 40-1416
ggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaa

SEQ ID NO: 193576 - DNA, 3938 bp, Homo sapiens
  Payload ID: 18220
  Gene Name: transmembrane protein 135
  Uniprot ID: Q86UB9
  ENST ID: ENST00000340353
  CDS Start-End: 203-1513
gtcccgcccccttgagctgcgatacgccgagcgctcaacatccgaggactttggcccagagtaaccccgctctcgtgacctttcccctccattccgcacctccgagtgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcatttcggtttcagacttcaaagttgattaataaatttaatcttaactttttattcactggaatcaaaacgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattccaaaatatgttttttagtttatttatatcctgaagaaatggtaagttttcactggaactgattacagtaaacaataatatgtccccttagtctttctgacatttttatatagattgagattgaaaaaccgtgcatttggggcagtggtattatggtcatttcgttgctattttctgttttaataaaatcctagaactagtagcaaccgagtaaagattgagtttgcaagataa

SEQ ID NO: 193577 - DNA, 496 bp, Homo sapiens
  Payload ID: 18220
  Gene Name: transmembrane protein 135
  ENST ID: ENST00000526733
  CDS Start-End: 126-496
acctttcccctccattccgcacctccgagtgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggagagggctgctcacaatttatatggccaacttggccacagaaacactattcagaatgggtgtagcaagaggaaccatcacaacattaagaaatggagaagt

SEQ ID NO: 193578 - DNA, 753 bp, Homo sapiens
  Payload ID: 18220
  Gene Name: transmembrane protein 135
  ENST ID: ENST00000525018
  CDS Start-End: 62-753
gcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttgaccgagtctcgctttgttgcccaggctggagtgcagtggtgtgatctcagctcactacaacctgcacctcccgggttcaagcgattcttgttcctcagccacctgagtagctgggattacagatttgtgccaccatgcctggctaatttttgtatttttgtagagatgaggtttcaccatgttagccaggctggtcttgaattcttggccttaagtgatccacctgccttggcctcccaaagtgctgagattacaggtgtgagccactgtgcctggcccaaaaacaagatttttaa

SEQ ID NO: 193579 - DNA, 1149 bp, Homo sapiens
  Payload ID: 18220
  Gene Name: transmembrane protein 135
  ENST ID: ENST00000532959
  CDS Start-End: 134-1123
tgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgac

SEQ ID NO: 193580 - DNA, 1434 bp, Homo sapiens
  Payload ID: 18221
  Gene Name: transmembrane protein 136
  Uniprot ID: Q6ZRR5
  ENST ID: ENST00000314475
  CDS Start-End: 328-1131
ttcctgttgccgcgatccgggccgggagctgcgggcgcccgggcgcccgaggcttcccggtgcgctccgccaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctggga

SEQ ID NO: 193581 - DNA, 4143 bp, Homo sapiens
  Payload ID: 18221
  Gene Name: transmembrane protein 136
  Uniprot ID: Q6ZRR5
  ENST ID: ENST00000375095
  CDS Start-End: 242-979
ctcttgacccccccgccagagaaggaggaccctcccgcgccctttcggagcgtcggtggcccggctccggctctgcgctccatcctcccagccagcaggtgcccccagacccccggctcctcctccgccgccgtcacagcctcgtcctccgcctctggctcctccgcttcctgttgccgcgatccgggccgggagctgcgggcgcccgggcgcccgaggcttcccggtgcgctccgccaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccatatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatggaatcacacaggatgcacttaattcccctagcagtgatttgttacgacatgtgaatgagttgtctactggacaaggtcactacagactcagtgcccaaagtttttactgaggacaggtcatctaggcaggctttccctggcagatagcaaaattcaagactctcaaaaggaaagcaggtgttcagcataagccatattgtttgcacaagcagttcagacacagtaagccagtcttatcagttaattgtgggagcccctccaaaatctaagttcccaaatgccggccagtggccaaccctgtaatcaggcctctccaaggatagcagtttaggcctgctatgttaactcttttctgcacaaaacctatagagttagggctttggatctgagatgaatgaagtgtgggtagatttactgagtcctgttatatgggttctgccctaccaggaaaactatgccagttctcagggcttttgtgcattaatctcctaggcatttgaggctatgactaaattccatagggatttatcatgtggattccactgtgcttgagatggcagtttagatttcagctctgctgtacatattgcaaactagagccaaagactttaaagtgtgtactggcctcagggggatgaggttaatttttttttttcattttagatactttcccttttagtactcctcctacttttcttatttttactaaaaaggtaccactctatgaacaaactaataaaacaaggccagtcttggaaggaaaaaaataataattcttagtgtgacagtctccaagagaagcaagaatataagcttagaacaaggggttaagaatccagaattcctgggttcttttaactaattttgctactcacttgccactttggagagctactcactcactttggataggttacttgtttcttctttgcctgagtttaaacctattgtgaatgaatgaaataccctgtagtatatttcataaatacattatgtggcattttattaatggaggtctttaatgtagggcttttatggaaatatgaagtatttatgtatttattgattatttatttttaccatgttattgaagtcaatggtgtttgattagctcagtgggtgagcaagcatatggtgctactggagtcaaggctggtcagtaggaagcatcagtccattccatggccactggtaatctaacgtaatgaatggtgtcttttgttgttgttgttgttgttgttgttgtttgagacagagtcttgctctgtcgcccaggctggagtgcagtggtgtgatctcaactcactgcaacctccgccttctgtgttcaagtgattctcctgcctcagcctcccgagtagctgggactacaggcgtgtgccaccatgcctggctactttttgtatttttagtagagacggggtttcaccatgttggccaggctggtcttgaactcctgacttcatgacccacccgcctcggcctcccaaagtgctgggattacaggtgtgagccaccgtgcccagccatgagcggtcttgaaaatgaaaaatggtcttggccacagaaaccaggtatgagggagtggttggaatggtataaagtcatcactgttagggaaacagtaactttaaatgcatgttaacagtgggtctttaaaaatgaatgtcatttggttaaagagttttgctgggcattgagataatctgacagcatctccacttcctgttttttttcttaatctccactttttttttttctatgatgagcgcccctaaaatgctggtaagcttctttccaacaaaattgcggtcaaagtaggatgctggggaatgctgattttagcaaaagcttgtagaaaagagtggcctggcacatgagcttaaaaaaaagaaaaaaagctggctcttgaattttggcacagtgcaacctgttccataccagacaaatgaacaggcttaatctggtaccaattctttttctctcttactcctcagaagtgaagggactgcagatcttgttgttttggggacactttcatggaactgtatgtaggtttttttgaatggtgagaaatctgaataattggtaaggggaagggaatccctcatttcagcttttcttgatgttgttactaataactatgaaaaaacttctgagagaacaatgtgaactgaagatgactcagcagttaagacaatgctaagttctgaaaccacaggtaaatgaagggctaattaatgtgtggtatacttggacaaaatgaagtactcatttgcactggattactgtgtaatgataacgaacactgttcaagaacgatttatatttccataagatttgtactaaattttataaaagtaaaacaactttttat

SEQ ID NO: 193582 - DNA, 3930 bp, Homo sapiens
  Payload ID: 18221
  Gene Name: transmembrane protein 136
  Uniprot ID: Q6ZRR5
  ENST ID: ENST00000529187
  CDS Start-End: 317-763
gcgatccgggccgggagctgcgggcgcccgggcgcccgaggcttcccggtgcgctccgccaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctgcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccatatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatggaatcacacaggatgcacttaattcccctagcagtgatttgttacgacatgtgaatgagttgtctactggacaaggtcactacagactcagtgcccaaagtttttactgaggacaggtcatctaggcaggctttccctggcagatagcaaaattcaagactctcaaaaggaaagcaggtgttcagcataagccatattgtttgcacaagcagttcagacacagtaagccagtcttatcagttaattgtgggagcccctccaaaatctaagttcccaaatgccggccagtggccaaccctgtaatcaggcctctccaaggatagcagtttaggcctgctatgttaactcttttctgcacaaaacctatagagttagggctttggatctgagatgaatgaagtgtgggtagatttactgagtcctgttatatgggttctgccctaccaggaaaactatgccagttctcagggcttttgtgcattaatctcctaggcatttgaggctatgactaaattccatagggatttatcatgtggattccactgtgcttgagatggcagtttagatttcagctctgctgtacatattgcaaactagagccaaagactttaaagtgtgtactggcctcagggggatgaggttaatttttttttttcattttagatactttcccttttagtactcctcctacttttcttatttttactaaaaaggtaccactctatgaacaaactaataaaacaaggccagtcttggaaggaaaaaaataataattcttagtgtgacagtctccaagagaagcaagaatataagcttagaacaaggggttaagaatccagaattcctgggttcttttaactaattttgctactcacttgccactttggagagctactcactcactttggataggttacttgtttcttctttgcctgagtttaaacctattgtgaatgaatgaaataccctgtagtatatttcataaatacattatgtggcattttattaatggaggtctttaatgtagggcttttatggaaatatgaagtatttatgtatttattgattatttatttttaccatgttattgaagtcaatggtgtttgattagctcagtgggtgagcaagcatatggtgctactggagtcaaggctggtcagtaggaagcatcagtccattccatggccactggtaatctaacgtaatgaatggtgtcttttgttgttgttgttgttgttgttgttgtttgagacagagtcttgctctgtcgcccaggctggagtgcagtggtgtgatctcaactcactgcaacctccgccttctgtgttcaagtgattctcctgcctcagcctcccgagtagctgggactacaggcgtgtgccaccatgcctggctactttttgtatttttagtagagacggggtttcaccatgttggccaggctggtcttgaactcctgacttcatgacccacccgcctcggcctcccaaagtgctgggattacaggtgtgagccaccgtgcccagccatgagcggtcttgaaaatgaaaaatggtcttggccacagaaaccaggtatgagggagtggttggaatggtataaagtcatcactgttagggaaacagtaactttaaatgcatgttaacagtgggtctttaaaaatgaatgtcatttggttaaagagttttgctgggcattgagataatctgacagcatctccacttcctgttttttttcttaatctccactttttttttttctatgatgagcgcccctaaaatgctggtaagcttctttccaacaaaattgcggtcaaagtaggatgctggggaatgctgattttagcaaaagcttgtagaaaagagtggcctggcacatgagcttaaaaaaaagaaaaaaagctggctcttgaattttggcacagtgcaacctgttccataccagacaaatgaacaggcttaatctggtaccaattctttttctctcttactcctcagaagtgaagggactgcagatcttgttgttttggggacactttcatggaactgtatgtaggtttttttgaatggtgagaaatctgaataattggtaaggggaagggaatccctcatttcagcttttcttgatgttgttactaataactatgaaaaaacttctgagagaacaatgtgaactgaagatgactcagcagttaagacaatgctaagttctgaaaccacaggtaaatgaagggctaattaatgtgtggtatacttggacaaaatgaagtactcatttgcactggattactgtgtaatgataacgaacactgttcaagaacgatttatatttccataagatttgtactaaattttataaaagtaaaacaactttttataaa

SEQ ID NO: 193583 - DNA, 1848 bp, Homo sapiens
  Payload ID: 18222
  Gene Name: transmembrane protein 138
  Uniprot ID: Q9NPI0
  ENST ID: ENST00000278826
  CDS Start-End: 560-1048
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagctccaacatggcggccagactggccatagagcgggaagagaaagccggggactagcaggccgcacggcgcagacggggcccgcctcctccatttacttccggaatttaaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaatgggggagtctgtctgtctagctagatctcttcatgttaagaggcgtgccaaggtccagcttaacatctacttgacccagagggaagatggagccacagatgaaatacagatctttgttgagatccattatgagtacaaagtattttagcagaaattcaagatggaatctgatgctgcatcccccactcctggagctccagatgtgtgtgctctgttcagactctctttccttatcagaagccttaactgccctcagaagaataaaaatattcccttagccagctttggcaaaagaaa

SEQ ID NO: 193584 - DNA, 1205 bp, Homo sapiens
  Payload ID: 18222
  Gene Name: transmembrane protein 138
  ENST ID: ENST00000381787
  CDS Start-End: 389-703
tgggcaacagaatgaaaccctgtctcgaaaaataaggagtatcagagaatcttctataggactatgtatggaagaaattttaaaaataaaaaagagtattagagcaggaaagccttgactatggactgcaaacccaactgatggggccagtgggtaattttaggtaattttagcttcatgtcattcaggtcccaaaacccatgttatctctgtgagggtttaagatgtcagatgcctatctcacaacaaaggacaggcctcgtggtgtccctcaggacatagtacctgctcttgggtcctcacacaggccttcattggttgtacttttttttatgtctacagcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatgaacttacgctggaaaaactccaacagcttcatatggacagatggacttcaaatgctgtttgtattccagagactagcagcagtgttgtactgctacttctataaacggacagccgtaagactaggcgatcctcacttctaccaggactctttgtggctgcgcaaggagttcatgcaagttcgaaggtgacctcttgtcacactgatggatacttttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctttccttcctttcctctctgtaccattcattctccctgaccggcctttcttgccgagggttctgtggctcttacccttgtgaagcttttcctttagcctgggacagaaggacctcccagcccccaaaggatctcccagtgaccaaaggatgcgaagagtgatagttacgtgctcctgactgatcacaccgcagacatttagatttttatacccaaggcactttaaaaaaatgttttataaatagagaataaattgaattcttgttccataaa

SEQ ID NO: 193585 - DNA, 2839 bp, Homo sapiens
  Payload ID: 18222
  Gene Name: transmembrane protein 138
  Uniprot ID: Q9NPI0
  ENST ID: ENST00000542946
  CDS Start-End: 200-517
aaagccggcttccggaagccgggacgatgtccgcatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacaccttcgtcttccaggctggcctggtcaacctcctattccataagttcaaagggaccatcatcctgacagctgtgtactttgccctcagcatctcccttcatgtctgggtcatggtaagagtggcagtctgaattctttttttaatttttattttaaatagaggtggggtcttactttgttaccaaggctggtctcaaactcctgagctcaagcaattctcctgcttctgcctcccaagctcaagcaattctcctgcttctgcctcccaaagtgctggaattacaggcatgagtcactgtgcccggcctgaactctgaattcctgaatcgctaaagggctaggaataacttttcttttcttttcttttctttttttttttttttgagacagagtctcgctctgtcgcctggctggagtgcagtggcgtgatctcagctcactgcaacctccgcttcctgggttcaagcaattctcctccctcagtctcctgagtacctgggattacaggcacgcaccaccacgcccagctaatttttgtgtttttagtagagactgggtttcaccatgttggccgggatggtctcaatctcttgacctcgtgatcctcctgcctcggcctctgaagtgctaggattacaggcgtgagctactgcgcccggccactgggatatcttttctctgggaacccagcttcattctttgacatctcacacaatccttcgtagagaacaggtgaaatgaaagtggtttgggttggagccctgggcatgtgagagtttcataaggtactcttgaccaaccttatgtgttgaaaaacagccttgtccaagagtcaggggactcttccagaacattcaattcacctttgccccaaacaggcctaccagggctaaaacaggtagttgaatgtgtctcatcattagctatttgggcaggtggatgttgatacaggttattcttaggcatcagtgccccatggctaatgctgtaggcagtggatgtttttggaagtagccaagcaggattgctgcttgcccttgagtgctccatgccgtctgccaagctcccatcactttaactaggagaaccggcctccaggatccctccctttggttctaacataggcctcagatcagatccagtgtctgtggtttcagatttcttctgcttcacaaattcttccagctctttgagtatcttgtatatttctcatgtactcaattcaattgaactctaaaacctcagggttctctagttgtcacttcattattaaagccactttcacacctgaaccccctgttaggttgtgcttgtgattccacagaaagaagtagaggtcccaggaaagaagcaaagcaacaccagagtctccgggtgcttcctgaagaggattctgtgccctggttcctggagccaaaataggtcctggctttgtactataaaagccgttaatctcattaaaccctgagtacaccaaagtctttatctgacaggagctgagccagcgatttttcaaggcaagacagtgaccagctgaactcctgagataatgaatatatcatttctccttggcaaaggttatggaattaaagagaataaataacttagttcatacttcctccctcaaagttaaaagatattccctttgcagcgaaaaatggagctttgaggctccttcgagaaacgctccttggggttgtagaaaggaggaagaggttagcatgattttaaagcaactggcatctctgcagctaaccaagttggagacattagggcttcttgtggccattaacttttgtgtatctcacatctccttcagaacttacgctggaaaaactccaacagcttcatatggacagatggacttcaaatgctgtttgtattccagagactaggtaaggaccagagcaaggtcaggcctctctcaggtcccacatgtgtctctttcagtgagggccttgatgctggcttcccagacctgtcccagctggcttgggatggttgtgacagccacaccaggaacaggagggattactgcccctgcccttgctagaagactatgggaaatgaggaggcagggctgcccagcctcattaggttctgttctttttgtttgtttgtttgtttgtttgtttgtttttgagacagtcttgctctgtcgcccaggctggagtgctgtggcgctatctcaggctcactgcaagctccgcctcccgggttcacaccattctcctgcctcagcctccggagtagctgggactacaggcgcccgccaccacgcccagctaattttttgtgtatttttagtagagacagggtttcaccgtgttagccaggatggtctcgatctctgacctcatgatccgcctgcctctgcctcctaaagtgctgggattacaggcgtgagccaccacgcctggccaggttctgttcttaacctgaaatgatactca

SEQ ID NO: 193586 - DNA, 2383 bp, Homo sapiens
  Payload ID: 18223
  Gene Name: transmembrane protein 139
  Uniprot ID: Q8IV31
  ENST ID: ENST00000359333
  CDS Start-End: 514-1164
tactttctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagcca

SEQ ID NO: 193587 - DNA, 1257 bp, Homo sapiens
  Payload ID: 18223
  Gene Name: transmembrane protein 139
  Uniprot ID: Q8IV31
  ENST ID: ENST00000409244
  CDS Start-End: 140-790
actttctacagtctgtggagacagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaa

SEQ ID NO: 193588 - DNA, 2114 bp, Homo sapiens
  Payload ID: 18223
  Gene Name: transmembrane protein 139
  Uniprot ID: Q8IV31
  ENST ID: ENST00000410004
  CDS Start-End: 245-895
tacagtctgtggagacaggtgagcgacgaacttctgagacagttgtgtccctgtggctttggtgcgcctgtgtgcactttctccctccacctggagcatgggctaacaccggaggaaaggaaaagacagagtcagacaggggcctgccccatcacctgaattccagagatgccagtgtgcactgaagccccaggcagggcgtgcccaggaccggatcctggatggtggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagcca

SEQ ID NO: 193589 - DNA, 1226 bp, Homo sapiens
  Payload ID: 18223
  Gene Name: transmembrane protein 139
  Uniprot ID: Q8IV31
  ENST ID: ENST00000409102
  CDS Start-End: 109-759
atgaaagtgataatcaggcagcccaaatgattgttaataaggatcaaatgagatcgtgtatgtgggtccaatcaattgattctacacaaaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaa

SEQ ID NO: 193590 - DNA, 1907 bp, Homo sapiens
  Payload ID: 18223
  Gene Name: transmembrane protein 139
  Uniprot ID: Q8IV31
  ENST ID: ENST00000409541
  CDS Start-End: 39-689
ttctacagtctgtggagacaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagcc

SEQ ID NO: 193591 - DNA, 1997 bp, Homo sapiens
  Payload ID: 18224
  Gene Name: transmembrane protein 140
  Uniprot ID: Q9NV12
  ENST ID: ENST00000275767
  CDS Start-End: 224-781
agagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttttacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgctgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggctgcacacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgtactctggtgtgatctcttgtcctcagtgtctcttctgggctcctgtccctcttgctttatagctagctgcccggggaccaaggtacaggtgaaagcaaggtagcagcttgcgggaggaggcctgtctggcttaccagtctatacactgtggcctcaacctcccagacagggcagagaactgtgggcagctcgtttgctttctaggctggctggagaggtgggagctcattgatagactcatgatggaaactatttttgaaacaggcttcctccttcaggagagatcatgcggactaaactgtagcaattccagtgca

SEQ ID NO: 193592 - DNA, 768 bp, Homo sapiens
  Payload ID: 18225
  Gene Name: transmembrane protein 141
  Uniprot ID: Q96I45
  ENST ID: ENST00000290079
  CDS Start-End: 17-343
ccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctcca

SEQ ID NO: 193593 - DNA, 2560 bp, Homo sapiens
  Payload ID: 18226
  Gene Name: transmembrane protein 143
  Uniprot ID: Q96AN5
  ENST ID: ENST00000293261
  CDS Start-End: 318-1697
aacgttggactgcgcgccgttggcggactgcgcgcgggagccctaccccgccccatccctctagggagtctcgcgtccacaccgccccttccctttgtagcaagctgacaaggagacactcctgcggcgcatgcgtcgcgcccaaacgaggccggcggtggagaaaggcaggcaacgcatgcgtagttgatgtagggagtcggcggtgagaaatggacagcccgcattgaccgaagctttgcgcatgcgttttactgctgggtgaagccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggaattccactcgagtccggcagagaaggcggctttggaggcgttctcggcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctg

SEQ ID NO: 193594 - DNA, 1960 bp, Homo sapiens
  Payload ID: 18226
  Gene Name: transmembrane protein 143
  Uniprot ID: Q96AN5
  ENST ID: ENST00000377431
  CDS Start-End: 19-1098
acatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtct

SEQ ID NO: 193595 - DNA, 2272 bp, Homo sapiens
  Payload ID: 18226
  Gene Name: transmembrane protein 143
  ENST ID: ENST00000435956
  CDS Start-End: 140-1414
atgcgtagttgatgtagggagtcggcggtgagaaatggacagcccgcattgaccgaagctttgcgcatgcgttttactgctgggtgaagccgaacctcgggagcccaggacgccctcctgcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataa

SEQ ID NO: 193596 - DNA, 571 bp, Homo sapiens
  Payload ID: 18226
  Gene Name: transmembrane protein 143
  ENST ID: ENST00000601522
  CDS Start-End: 166-571
aggcaacaggggctttgaggcgagcggatgggctctgcgccctgcctggggtagagacggcttctggagggtgggacgtggaggtggagagggcgcttttcctctagatggcctttgacccctgcccattttcctctgtttaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggaattccactcgagtccggcagagaaggcggctttggaggcgttctcggcccacgtggacttctgcaccctgttccactaccaccaaatcctggcccggctgcaggccttatatgaccccatcaaccctgacagggagaccctcgatcagccatcactaacggatccccagcgtctgtctaatgagc

SEQ ID NO: 193597 - DNA, 565 bp, Homo sapiens
  Payload ID: 18226
  Gene Name: transmembrane protein 143
  ENST ID: ENST00000599220
  CDS Start-End: 19-327
acatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacagagacaggatttcaccatgttggccacgctggtcttgaactcctgacttcaagtgatccactgcctcggcctcccaaagtgctgggattacaggaattccactcgagtccggcagagaaggcggctttggaggcgttctcggcccacgtggacttctgcaccctgttccactaccaccaaatcctggcccggctgcaggccttatatgaccccatcaaccctgacagggagaccctcgatcagccatcactaacggatccccagcgtctgtctaatgagcagga

SEQ ID NO: 193598 - DNA, 541 bp, Homo sapiens
  Payload ID: 18226
  Gene Name: transmembrane protein 143
  ENST ID: ENST00000598926
  CDS Start-End: 30-541
acaggcaacaggggctttgaggcgagcggatgggctctgcgccctgcctggggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggaattccactcgagtccggcagagaaggcggctttggaggcgttctcggcccacgtggacttctgcaccctgttccactaccaccaaatcctggcccggctgcaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaa

SEQ ID NO: 193599 - DNA, 748 bp, Homo sapiens
  Payload ID: 18226
  Gene Name: transmembrane protein 143
  ENST ID: ENST00000597370
  CDS Start-End: 2-283
aatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacagagtcttgatgttgtctagtctggagggcagtggcacgatctcgactcactgcagcctccgcctccctggttcaagcaattctccagcttcagcctcctgagtagctgggactacaggtgcatgccatcacgcccggctaatttttgtatttttagtagagacaggatttcaccatgttggccacgctggtcttgaactcctgacttcaagtgatccactgcctcggcctcccaaagtgctgggattacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcactt

SEQ ID NO: 193600 - DNA, 3442 bp, Homo sapiens
  Payload ID: 18227
  Gene Name: transmembrane protein 144
  Uniprot ID: Q7Z5S9
  ENST ID: ENST00000296529
  CDS Start-End: 521-1558
aacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 193601 - DNA, 2861 bp, Homo sapiens
  Payload ID: 18227
  Gene Name: transmembrane protein 144
  ENST ID: ENST00000511532
  CDS Start-End: 215-799
ggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataa

SEQ ID NO: 193602 - DNA, 535 bp, Homo sapiens
  Payload ID: 18227
  Gene Name: transmembrane protein 144
  ENST ID: ENST00000503200
  CDS Start-End: 204-535
gtagagggaatgagtcaggctccggctccacactggcacgtagtgggcggatcgcgccggcgctgagtaggaaggagcttcagccgccagcccggaacgcacagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaag

SEQ ID NO: 193603 - DNA, 764 bp, Homo sapiens
  Payload ID: 18227
  Gene Name: transmembrane protein 144
  ENST ID: ENST00000505189
  CDS Start-End: 504-764
agtgacattccatgagacaagcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaa

SEQ ID NO: 193604 - DNA, 576 bp, Homo sapiens
  Payload ID: 18227
  Gene Name: transmembrane protein 144
  ENST ID: ENST00000504569
  CDS Start-End: 164-576
acgtagagggaatgagtcaggctccggctccacactggcacgtagtgggcggatcgcgccggcgctgagtaggaaggagcttcagccgccagcccggaacgcaaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaag

SEQ ID NO: 193605 - DNA, 546 bp, Homo sapiens
  Payload ID: 18227
  Gene Name: transmembrane protein 144
  ENST ID: ENST00000511038
  CDS Start-End: 516-546
atgagacaagcagtcctgtggtgaggcccatgtcaagaaggcctgagatctcccaccatcagctacagccaatttgtcagtcactcatcatttctcattatacacagagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttg

SEQ ID NO: 193606 - DNA, 1070 bp, Homo sapiens
  Payload ID: 18227
  Gene Name: transmembrane protein 144
  ENST ID: ENST00000508243
  CDS Start-End: 570-1070
ttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatc

SEQ ID NO: 193607 - DNA, 525 bp, Homo sapiens
  Payload ID: 18227
  Gene Name: transmembrane protein 144
  ENST ID: ENST00000514971
  CDS Start-End: 253-525
agtctctccgtttcagaggtgtagggcctttgtggagccttctcaataaaataatttgccactcttgaagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggttta

SEQ ID NO: 193608 - DNA, 731 bp, Homo sapiens
  Payload ID: 18227
  Gene Name: transmembrane protein 144
  ENST ID: ENST00000512481
  CDS Start-End: 471-731
aaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaa

SEQ ID NO: 193609 - DNA, 575 bp, Homo sapiens
  Payload ID: 18227
  Gene Name: transmembrane protein 144
  ENST ID: ENST00000505049
  CDS Start-End: 344-575
agtgacattccatgagacaagcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacag

SEQ ID NO: 193610 - DNA, 1633 bp, Homo sapiens
  Payload ID: 18227
  Gene Name: transmembrane protein 144
  ENST ID: ENST00000509278
  CDS Start-End: 285-506
cgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggtaattatttttccttgattgttaacgttatattatttttaaaaatgaagttccttttttggtcttttaaaagtatagctacaaaaataaatcatgttgatcttgatacctagtgaatagagcttaaaattagtcatttgacagtgctcataccagtttgtctgaaagtcagaataggagaaccattaaggttgtttcatggtaaagttagggagggtacagtcaggaaatctcttgggccattatatgaatggaagaaatttatagtcagttctactataacacctgttttgaaaacatgaatcttcaacatgattgatatattagagaacaatgtaagcataacagatttttggcttgcttatgtgcaattttgtccctgagaaacctctagataggcacagaagactgcacctagatgaataaagatgtgtgataatacacataatgcacgcagacacacgtacaatcttcaaatatcgaccagctcccttagttcatcacatgtggttatgatgtattccacccaaccacatctcctgtcccaactcctcacccaataccttcacagtaactcgtaagctgcaaccctttggatgctcacttccaggagcaaacttctggtgtttttcaattaaaatgccctatttattacagcatcatgtaattaaccagttaaccagttaaaactgtactactattttaattaggttgagtgttgttctcctagccccattttcccattatgctctgtagtttttactgcatgattttgcatagtgcagtgatttcaaggaatgcacatgttacattatagcagaactgactaatgtgaattttggggaaggagaagcaagagttatttgtatttgcctgacttccatattaaagccaggagaaggaattgagatttatggtgaacacatgttgggaattacttccttggtagtatttatcacctgacagcagttgtgttatttccccaattctttgtcttcgtgcacttagaaaataggattacctcctattttcctccagggcctttcttctcttttcctctggagttaggacaagaatgggaactacccgaagaacaaaaaaatgggtagaggatctagcttttttagtcttccacaattagctttgtgatcctgggcaaatattaccagctctgctgttttcagtttctcatttgtaaagtgaacaacttataaaatgaagtttcttttcatctctgtga

SEQ ID NO: 193611 - DNA, 642 bp, Homo sapiens
  Payload ID: 18227
  Gene Name: transmembrane protein 144
  ENST ID: ENST00000502698
  CDS Start-End: 411-642
gtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacag

SEQ ID NO: 193612 - DNA, 3699 bp, Homo sapiens
  Payload ID: 18227
  Gene Name: transmembrane protein 144
  Uniprot ID: Q7Z5S9
  ENST ID: ENST00000514558
  CDS Start-End: 1797-2306
cgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctcagctgacccttgagccataacccatgtaagtcactgcagggctgaacctctctttgagcctaacagtagaataataattatttttattgaatagtgttaatgtgtcaatgttgaaatgtgcctcagtgtgtcttcctcaaccacatccctatagaggatgttttcttaatagcaatgtgtttttgttttaagaaagtccacacaatttcaaatacacattttctttactaaagtttattgaccagttttgaagtgatccttgttttcagttaaactatctttaataatggtaaataacatattttgtaggttgttgtatatttaatattctctgcaagaacacataaggaacaatacatggacctttaaatatttgtcattgtgaaataaaataacaaggaaaggtgatttcaggtgtactttattcaatacatatatacaagaagttattactataacattaaatttgcaggaaaaaagaaaccactggattattctgcttctattccagagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgagtatagtatgagagacaacttgatttgaaacataaaattaagataaatggataatacataaattttaaacacagatgaaaaagtggtgtttgctcatcactcctggctatgtaaaatatcttagcttatttattatgggtaggtctatgtagcaatcaatcaatatttccgcagttgagcttctcagcaagcacacgggtttatttattttgattaacagatctctactaggtgatatatatataaccccatttttgtaatgatttaaagattcctacaatagaggaaccctaaatactgtagaggaatgtgaaaataactttagaaagtcagaggaaggaggttttgaagttggtccaggggagaatagaccataggaggccaagaaaggtaagtgaagtcctatgagaataggaactggtatcccattctacccgaagtgaaaaacagaaaatatgataggagtcactgttttgatcttgaagaatctaaatcagtctggaatagtaaatctgaatgaaacaggagcaacttttaaaagggacctgataaagcgcaagtgtcagtagctacatatacaaaagtgacttcagggcaaagcctcattgtcatgaacccaggctctaatccttctcatctcaagaaatctctcctgtctgccctgggccagtgctatccagctgccctctgaatccagcgctcctcacccccagtggggtattgccccttggcagggtgcttatttaccccttacttcaaaattaatcttttctcctttccttcttcccctatccaaacttttatcaactaaaaccttagttaaattgacactaaagttgaatagtaattagcttaagtgtaaagagaagaggtttattaatccacaggcatctctaatcagggaaatgtttcagggagaagggaggagttggctttgggaaagggttccttgcctgcttcagggatccagacacctcctgcccaaccatcctccaaaacaatggaacaaaataataaaataaatgcagcttggtaaaagatacacagtaggctaactgcctgagatttttctaggcaataagtttaaagatccataaacagcatgattgatgggtacagaaccatgcatcatgagctccttatgatgaaagaaaccgttattgccaaaggaaaacttgacttagcacatgacaaagaattcaaatctactttcttgtctcttacaaaaataataggattataacatcaagaacacttcagttggccaggcgtgatggctcatgcccgtaatcccagcactgtgggaggtcaaggtgggcagatcacctgagttcaggagttcaagaccagcctgtccaacatggtgaaactctatctctactaagaatacaaaaaaaaaaaaaa

SEQ ID NO: 193613 - DNA, 1768 bp, Homo sapiens
  Payload ID: 18228
  Gene Name: transmembrane protein 145
  Uniprot ID: Q8NBT3
  ENST ID: ENST00000301204
  CDS Start-End: 42-1523
agtgcgggagccggagcggagccggggccggagcgggcggaatggagcccctgcgcgcgcccgcgctgcgccgcctgctgccgccgctgctgctcctgctgctgtcactgcccccccgcgcccgggccaagtacgtgcggggcaacctcagttccaaggaggactgggtgttcctgacaagattttgtttcctctcggattacggccgactggacttccgtttccgctaccctgaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcaggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatatttgctgaaaggtcgtcagttgctccacacaacttataaaatgttcatggccgcagcaggagtagaggtcctgagcctcctatttttctgcatctactggggtcaatatgccaccgatggcattggcaacgagagtgtgaagatcttggccaagctgctcttctcctccagcttcctcatcttcctgctgatgcttatcctcctggggaagggattcacggtgacacggggccgcatcagccacgcgggctccgtgaagttgtctgtctacatgaccctgtacacgctcacccatgtggtgctgctcatctacgaggcggaattctttgacccaggccaggtactgtacacgtatgagtcgccggccggctacgggctcattggactgcaggtggcggcctacgtgtggttctgctatgctgtgcttgtctcactgcgacactttcctgagaagcagcctttttatgtgcccttctttgctgcctataccctctggttctttgcggttcctgtcatggccctgattgccaatttcggcatccccaagtgggcccgggagaagattgtcaatggcatccagctggggatccacttgtacgcccatggcgtgtttctgatcatgacccgcccatcagcggccaacaagaacttcccgtaccacgtgcgcacgtcgcagatcgcttcagccggagtccctggacccggagggagccaatccgctgacaaggccttcccgcagcacgtctatgggaacgtgacgtttatcagcgactcggtgcccaacttcacggagctcttctccatccccccgcccgccacctcccccctgccccgagcggcgccggattctgggctcccgctgttccgtgacctccggccccctggcccccttcgagacctctgaccccgctggactccggaacacccgtggtgaccgccgggaccctgcctgtgactctccaggactctgcgaccccgggatggatattgcgatgctggtctcgaccctgaaaccctccctcggatctgtgacctcggacccgtactccatctgccgcatctccattccgggggccttccctcgggtccctggcagaaagacattttaccccttcttgccaaaataaaaaaggattcgtttttatctat

SEQ ID NO: 193614 - DNA, 338 bp, Homo sapiens
  Payload ID: 18228
  Gene Name: transmembrane protein 145
  ENST ID: ENST00000601644
  CDS Start-End: 1-237
catccccaagtgggcccgggagaagattgtcaatggcatccagctggggatccacttgtacgcccatggcgtgtttctggttctcctgcctcagcctccggagtagctgggactacaggagcacgccaccatgcccgtagagacggggtttcactatgttggccaggatggtctcgatctcctgacctcatgatccgcccgcctcggcctcccaaagtgctgggattacaggagtgagccactgcgcctggcccccaccacgtctattctttgccctggttcacatcctatctgacattcttggtgacagttctaatattcattaatttattcatcaa

SEQ ID NO: 193615 - DNA, 2011 bp, Homo sapiens
  Payload ID: 18228
  Gene Name: transmembrane protein 145
  ENST ID: ENST00000598766
  CDS Start-End: 1-1467
atggagcccctgcgcgcgcccgcgctgcgccgcctgctgccgccgctgctgctcctgctgctgtcactgcccccccgcgcccgggccaagtacgtgcggggcaacctcagttccaaggaggactgggtgttcctgacaagattttgtttcctctcggattacggccgactggacttccgtttccgctaccctgagctcccggtccccaacatctctggtctgcaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcagtgcgtgaacggtggtggtatattgcgctcagcaagtgtgggggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatatttgctgaaaggtcgtcagttgctccacacaacttataaaatgttcatggccgcagcaggagtagaggtcctgagcctcctatttttctgcatctactggggtcaatatgccaccgatggcattggcaacgagagtgtgaagatcttggccaagctgctcttctcctccagcttcctcatcttcctgctgatgcttatcctcctggggaagggattcacggtgacacggggccgcatcagccacgcgggctccgtgaagttgtctgtctacatgaccctgtacacgctcacccatgtggtgctgctcatctacgaggcggaattctttgacccaggccaggtactgtacacgtatgagtcgccggccggctacgggctcattggactgcaggtggcggcctacgtgtggttctgctatgctgtgcttgtctcactgcgacactttcctgagaagcagcctttttatgtgcccttctttgctgcctataccctctggttctttgcggttcctgtcatggccctgattgccaatttcggcatccccaagtgggcccgggagaagattgtcaatggcatccagctggggatccacttgtacgcccatggcgtgtttctgattcttccatttctcttttgtatccccactgccttccccaccctccttgatctctccactctccccctgcccctgcccaaattctgccatcacaggccactgttcaggaagaagcatctggggtggcacagggtgaagcttttgggctcctgggtcggcaacaggagggtacagcaccacatcttttttttttttttttgagacggagtctcactctgtcactaggctggagtgcagtggcgcgatcttggctcactgcaacctccacctcccaggttctcctgcctcagcctccggagtagctgggactacaggagcacgccaccatgcccggttaagtggtttttttttttttttttttttgagacggagtcttgctctgttgcccaggctggagtgcagaggtgcgatctcggctcactgcaacttctgcctcccaagttcatgccattcccctgcctcagcctccctagtagctgggactacaggcgcccaccaccacgcctagcaaattttttttgtatttttagtagagacggggtttcactatgttggccaggatggtctcgatctcctgacctcatgatccgcccgcctcggcctcccaaagtgctgggattacaggagtgagccactgcgcctggcccccaccacgtctattctttgccctggttcacatcctatctgacattcttggtgacagttctaatattcattaatttattcatcaattgttcactgggca

SEQ ID NO: 193616 - DNA, 899 bp, Homo sapiens
  Payload ID: 18229
  Gene Name: transmembrane protein 147
  Uniprot ID: Q9BVK8
  ENST ID: ENST00000222284
  CDS Start-End: 146-820
gctcccagaaggtcgcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaagtt

SEQ ID NO: 193617 - DNA, 935 bp, Homo sapiens
  Payload ID: 18229
  Gene Name: transmembrane protein 147
  Uniprot ID: Q9BVK8
  ENST ID: ENST00000392204
  CDS Start-End: 329-856
aggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaagtt

SEQ ID NO: 193618 - DNA, 767 bp, Homo sapiens
  Payload ID: 18229
  Gene Name: transmembrane protein 147
  ENST ID: ENST00000392205
  CDS Start-End: 60-614
ccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagtgagttgggtggggtttagggctgggtccaaagtggggtgggttatctagtctcccttccttattgtgacattttcctgcaggaccttcgtccacctctgctcgctgggcagttgggcagctctactggcccgagcagtggtaacggggctgctgg

SEQ ID NO: 193619 - DNA, 669 bp, Homo sapiens
  Payload ID: 18229
  Gene Name: transmembrane protein 147
  ENST ID: ENST00000593027
  CDS Start-End: 242-337
cagaaggtcgcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaa

SEQ ID NO: 193620 - DNA, 992 bp, Homo sapiens
  Payload ID: 18230
  Gene Name: transmembrane protein 14A
  Uniprot ID: Q9Y6G1
  ENST ID: ENST00000211314
  CDS Start-End: 154-453
gctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 193621 - DNA, 787 bp, Homo sapiens
  Payload ID: 18231
  Gene Name: transmembrane protein 14B
  Uniprot ID: Q9NUH8
  ENST ID: ENST00000379530
  CDS Start-End: 116-358
gtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaa

SEQ ID NO: 193622 - DNA, 975 bp, Homo sapiens
  Payload ID: 18231
  Gene Name: transmembrane protein 14B
  Uniprot ID: Q9NUH8
  ENST ID: ENST00000379542
  CDS Start-End: 168-512
gcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 193623 - DNA, 565 bp, Homo sapiens
  Payload ID: 18231
  Gene Name: transmembrane protein 14B
  ENST ID: ENST00000460341
  CDS Start-End: 166-273
ctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattattttgcaacagttctgaactcagttccgctgcctccctgagacccaatcctgcctctctgtcctaaaaacagtttccaccgccagcccaagcagcaggggagcagaggaaacggcgggggcagcaggcgggcctacggccggcccagagagggcgtggcctcgcgggaaat

SEQ ID NO: 193624 - DNA, 752 bp, Homo sapiens
  Payload ID: 18231
  Gene Name: transmembrane protein 14B
  ENST ID: ENST00000473166
  CDS Start-End: 168-275
gcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattgtggagcactgcccaacacacagtagatactgcatgtggcagacacacgatagggtctcactaggtcacctaagctgaagtacagtagtggtggcactatcttggctcactgcagcctcgacctcctgggctcaagcaatcctcccacctcagcctcccgagtggctgggactatagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatg

SEQ ID NO: 193625 - DNA, 559 bp, Homo sapiens
  Payload ID: 18231
  Gene Name: transmembrane protein 14B
  ENST ID: ENST00000461342
  CDS Start-End: 122-427
aatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccaggtactttcattctattactcttctttaccatgtagagttcagtttattgcccagaatactttatgcattcaaaaccttacttgtttcagagtatctgatgctatgcatcaactgacgtttgacttatacactaataggagatgcttcaaaaacaatagttgatttaatgtcaaatgacatgagtatatccattcactgtggagatggctttgttctctggtcctagctccttcctatatggtggcag

SEQ ID NO: 193626 - DNA, 992 bp, Homo sapiens
  Payload ID: 18231
  Gene Name: transmembrane protein 14B
  ENST ID: ENST00000475942
  CDS Start-End: 122-529
aatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggtactttcattctattactcttctttaccatgtagagttcagtttattgcccagaatactttatgcattcaaaaccttacttgtttcagagtatctgatgctatgcatcaactgacgtttgacttatacactaataggagatgcttcaaaaacaatagttgatttaatgtcaaatgacatgagtatatccattcactgtggagatggctttgttctctggtcctagctccttcctatatggtggcagaagttttattgcaaagctatgactgcagccttttgtgtgacttgcggaggatgtgtgggggtcccatatttcttaggtgtgtaggtgtcttttgtagaaaattttgctaaaaggaaattttgattgaatcctgttttctaattttgattataatacctaaaccaaattgtggtttttaaaaaatgtagttgtaggccaggcacggtggctcacacctgtaatccaagcacagtgggaggccatggcgggcatatcacttgaggtcaggagtttgagaccagcctggccaacatggtgaaactcctctctatgaaaaatacaaaaattaggt

SEQ ID NO: 193627 - DNA, 344 bp, Homo sapiens
  Payload ID: 18231
  Gene Name: transmembrane protein 14B
  ENST ID: ENST00000478732
  CDS Start-End: 1-144
gtttctggtgggatcgttggctatgtaaaaacaggcagcgtgccgtccctggctgcagggctgctcttcggcagtctagccggcctgggtgcttaccagctgtatcaggatccaaggaacgtttggggtttcctaggaatctagaaaactgtatctgaagttgttcctacctgaagccgttgcattgagaggtgctaagtggatcctctggccagctgactgcacttcttttttgagaaaggaaggaatatatcctgactgattgatctggctctgttatccaggttggagtgcagtggagcaatcatggctcactacagcctcaccctcccgggctcaaaaga

SEQ ID NO: 193628 - DNA, 559 bp, Homo sapiens
  Payload ID: 18231
  Gene Name: transmembrane protein 14B
  ENST ID: ENST00000473807
  CDS Start-End: 126-233
acgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattgatctggctctgttatccaggttggagtgcagtggagcaatcatggctcactacagcctcaccctcccgggctcaaaagatcctcctacctcagactcctgagtagctgggactacaggtgcgcaccatcacacctggctaatttttttttgtggagacggggtttcactatgttgcccaggctggtcttgaactcctgggctcaa

SEQ ID NO: 193629 - DNA, 1589 bp, Homo sapiens
  Payload ID: 18231
  Gene Name: transmembrane protein 14B
  ENST ID: ENST00000463448
  CDS Start-End: 168-275
gcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattacagagtctcactctgtcgccaggctggacaggctggagtgcagttgtgcgatctcggctcactacaacctctgcttcccgggttcaagtgattctcctgcctcagcctcccgagtagctgggattacaggtgcgcgtcaccacgcccagctaatttttgtattcttagtagagacggggtttcaccatgtcggcgaggatggtcttgatctcttgacctcatgatctgcccgcctcggccttccagagtgctgggattacaggcgtgaggcactgcgcccagcccagattggataatttctgaaaaattgtttgcaagtgcatggacactttcttctatcatctccaatctgctggtaagcctatcccatggtgttttattttattttaaagccttcgattttcagttctagacttttaaacttggatcatttaaatagtttccatattctgttgaaattctctatatctttttatttatgatgacaatattttccttaggtctttgaatatttataatagctgttttaaagttcttgtcagctatttccaacatctgagccatctcacatctttttctatagactgcttctcctcttaacctcatggtactagtcttatttacttaaatagctactattttgtttgtatattgtacatgatgaataatatgttgaagagttttggattttacctttcttaactgagtgttgctttctgttttaagtaatcaattgctttttcgacaaatcaccttaaatttgtggatgcttagtattaccctttctaaagatgcattcattttagctttggcactagttttagggtgaattccttagatgtagaacatacagtttactcttagggcatggccttagtgctatgcaaactccaaattccatctcccttgcagtgcgcagccgacgagatggttgctttgttttgacgctttccagctgttgctttacgttgacatctttagagtctcatctcgttaagccctgttcaggtgtcagccaagaattcaaagtgagtttaaacacaaattttagggtttcctctttgtggctccctcttttccaaggtccgtcccctcaatttccaggtcctttggcagccccagactccatcctctgacaagtcaaaagcatcgcaatttctgctcagtcctagccattccacgccttgtgcact

SEQ ID NO: 193630 - DNA, 483 bp, Homo sapiens
  Payload ID: 18231
  Gene Name: transmembrane protein 14B
  ENST ID: ENST00000467229
  CDS Start-End: 1-178
cagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggaatctagaaaactgtatctgaagttgttcctacctgaagccgttgcattgagaggtgctaagtggatcctctggccagctgactgcacttcttttttgagaaaggaaggaatatatcctgactgattcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaatc

SEQ ID NO: 193631 - DNA, 502 bp, Homo sapiens
  Payload ID: 18231
  Gene Name: transmembrane protein 14B
  ENST ID: ENST00000463100
  CDS Start-End: 116-223
gtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggaatctagaaaactgtatctgaagttgttcctacctgaagccgttgcattgagaggtgctaagtggatcctctggccagctgactgcacttcttttttgagaaaggaaggaatatatcctgactgattcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacaga

SEQ ID NO: 193632 - DNA, 1032 bp, Homo sapiens
  Payload ID: 18231
  Gene Name: transmembrane protein 14B
  ENST ID: ENST00000481240
  CDS Start-End: 96-449
gctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcaggtgtgcaccaccacacccagctaattttttgtatttttagtagagatggggtttcaccatgttggccaggctggtcttgaactgacctcaggtgatccacctgtcttgcctcccaaagtgctggaattacaggcatgagccaccgcaccaggccaagatctaattctttttaatggcttttaagttgtacggatgattactatttagtttactattcccctactgatagaaatatgtcttgtttaatgcctttgatagccgggagcagtggctcatgcttgtaatcccaacactttgggaggctgaggtgggcagatcccctgaggcctttgatattacaaaggatggtgtaccaagaaatatcctcatggaaatccccgtgaacatgtgcaaaggaatctgtaggttacattcctaaatgctgagtcagagcatctcagcatttaaaattgtgattgccttcagaagaggatgcaccaatttatcctcccactagtggtggctttgtgtaattggactttgtaaaaatctttgacacattaagctggaagtctgcaaacttgttctgtaaagggccagatagtgaatattttaggcttctcaggccatctgtgtcccagctg

SEQ ID NO: 193633 - DNA, 730 bp, Homo sapiens
  Payload ID: 18231
  Gene Name: transmembrane protein 14B
  ENST ID: ENST00000473276
  CDS Start-End: 110-271
ggagagacctggctgctgtgtcccgcggcttgcgctccgtagtggactccgcgggccttcggcagatgcaggcctggggtagtctcctttctggactgagaagagaagaatggagaagcccctcttcccattccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactat

SEQ ID NO: 193634 - DNA, 1224 bp, Homo sapiens
  Payload ID: 18231
  Gene Name: transmembrane protein 14B
  ENST ID: ENST00000467317
  CDS Start-End: 96-551
gctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagatggagtatggctcttgttgcccaagctggggtgcaatggtgcgatctcagctcattgcaacctccacctcccaggttcaagcgattctcctgccttaccctcctgagtagctgggatttcaggtgtgcaccaccacacccagctaattttttgtatttttagtagagatggggtttcaccatgttggccaggctggtcttgaactgacctcaggtgatccacctgtcttgcctcccaaagtgctggaattacaggcatgagccaccgcaccaggccaagatctaattctttttaatggcttttaagttgtacggatgattactatttagtttactattcccctactgatagaaatatgtcttgtttaatgcctttgatagccgggagcagtggctcatgcttgtaatcccaacactttgggaggctgaggtgggcagatcccctgaggcctttgatattacaaaggatggtgtaccaagaaatatcctcatggaaatccccgtgaacatgtgcaaaggaatctgtaggttacattcctaaatgctgagtcagagcatctcagcatttaaaattgtgattgccttcagaagaggatgcaccaatttatcctcccactagtggtggctttgtgtaattggactttgtaaaaatctttgacacattaagctggaagtctgcaaacttgttctgtaaagggccagatagtgaatattttaggcttctcaggccatctgtgtcccagctgttcacctctgcctttgtagaatgaaagcagccacagccaatcaataaacgagtgtgactgttccaataaaactatgtatgggccctgaaa

SEQ ID NO: 193635 - DNA, 888 bp, Homo sapiens
  Payload ID: 18231
  Gene Name: transmembrane protein 14B
  ENST ID: ENST00000612333
  CDS Start-End: 124-435
gcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattgcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttact

SEQ ID NO: 193636 - DNA, 1113 bp, Homo sapiens
  Payload ID: 18232
  Gene Name: transmembrane protein 14C
  Uniprot ID: Q9P0S9
  ENST ID: ENST00000229563
  CDS Start-End: 312-650
aggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccccattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 193637 - DNA, 1177 bp, Homo sapiens
  Payload ID: 18232
  Gene Name: transmembrane protein 14C
  Uniprot ID: Q9P0S9
  ENST ID: ENST00000541412
  CDS Start-End: 386-724
gccctgcaggcgctgcggacaggggaagcacagagattccccgccgcgttccctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccgcttgttttctgcaggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccccattccctgctctgaggaacagtgtgaaaaaaagtcttttaggagatttacaatatctgttcttttgctcatcttagaccacagactgactttgaaattatgttaagtgaaatatcaatgaaaataaagtttact

SEQ ID NO: 193638 - DNA, 378 bp, Homo sapiens
  Payload ID: 18233
  Gene Name: transmembrane protein 14E, pseudogene
  Uniprot ID: Q6UXP3
  ENST ID: ENST00000408960
  CDS Start-End: 1-378
atgcagatggaccctggcccacaggtgcctttatactggcttggctttgtctatgcagcactggctgctttaggtgggatcagtggttatgcaaaagtaggttctgtccagtccccttctgctggattcttcttcagtgagttagcaggcctggatgcttctcagccatcacggaatccaaaggaacatttgagttctcccgtttacatctgggatcttgctaggtattatgcgaataagattctaacactctggaacatttacgcttgtgggtttagttgcaggtgcctgctgatagtttccaaacttggaagtatgtatggtgaacagatcctgtcagttgtagctatgtctcagcttggactcatgaagaattaa

SEQ ID NO: 193639 - DNA, 1484 bp, Homo sapiens
  Payload ID: 18234
  Gene Name: transmembrane protein 150A
  Uniprot ID: Q86TG1
  ENST ID: ENST00000306353
  CDS Start-End: 300-956
aaacctttcagggctgctccgagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgc

SEQ ID NO: 193640 - DNA, 1518 bp, Homo sapiens
  Payload ID: 18234
  Gene Name: transmembrane protein 150A
  Uniprot ID: Q86TG1
  ENST ID: ENST00000334462
  CDS Start-End: 189-1004
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaa

SEQ ID NO: 193641 - DNA, 1776 bp, Homo sapiens
  Payload ID: 18234
  Gene Name: transmembrane protein 150A
  Uniprot ID: Q86TG1
  ENST ID: ENST00000409668
  CDS Start-End: 469-1284
aggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtatttt

SEQ ID NO: 193642 - DNA, 779 bp, Homo sapiens
  Payload ID: 18234
  Gene Name: transmembrane protein 150A
  ENST ID: ENST00000451147
  CDS Start-End: 235-372
tggtgcctgggcacacagccccttgggacaagctggcaccactgctgtccagcagggtggccctgacaaatatacttctagccagggcaatttccagagggcctgtagctgggggcatgctgcaggtgctggtgtggcatcaagccttagggacctcaacttgagtccccagcaacaataatgaggctgaatggggccagaaatcaaggtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccg

SEQ ID NO: 193643 - DNA, 428 bp, Homo sapiens
  Payload ID: 18234
  Gene Name: transmembrane protein 150A
  ENST ID: ENST00000425160
  CDS Start-End: 228-428
tgggcacacagccccttgggacaagctggcaccactgctgtccagcagggtggccctgacaaatatacttctagccagggcaatttccagagggcctgtagctgggggcatgctgcaggtgctggtgtggcatcaagccttagggacctcaacttgagtccccagcaacaataatgaggctgaatggggccagaaatcaaggtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcacc

SEQ ID NO: 193644 - DNA, 821 bp, Homo sapiens
  Payload ID: 18234
  Gene Name: transmembrane protein 150A
  ENST ID: ENST00000433956
  CDS Start-End: 165-344
cacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggtcctacaacgagtcctgccctcctgaccctgctgagcaagggggtcccaagacctgctgcaccctggacgatgtccccctcatcaggtcacacagctaataagcggaggcacctggatttaagctggagccctcagattgcccagcccgtgttctggctcaaggatagccaaaccagccgcagggctcagcaaagagtgtcagggttgcccgaacactcctgggcactcccttctctctcacacacatgagctctgctttgggggcccagcctggaaccagttgttcatgagggaccctggatcttcacataaatcagtggcctgcctgctaaggagcaggtgcagcaagtgtggctcctatcccccagaaagctgcctcttcagcctcattggcaacatgggtgctttcatgg

SEQ ID NO: 193645 - DNA, 803 bp, Homo sapiens
  Payload ID: 18234
  Gene Name: transmembrane protein 150A
  ENST ID: ENST00000422458
  CDS Start-End: 27-164
gtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgct

SEQ ID NO: 193646 - DNA, 943 bp, Homo sapiens
  Payload ID: 18235
  Gene Name: transmembrane protein 150B
  Uniprot ID: A6NC51
  ENST ID: ENST00000326652
  CDS Start-End: 184-885
ggctccagacacccaacctacccgtggccggatgtctgcctgagccccaccccgaatgccagcccttcttccctgagctcacccagccccagctccaggactgagagccccaggaagcttggagaggtgtgagagagacaggtgtccagcctcagccccgatccttcacctgcagagcccggcatgtggggctacctgtcgctgatgcctgtcttcctagctgtctgggctatctctggcgtctggatcgtttttgccattgcagtgaccaacaggactgtggacctcagtaaaggctttccctacatcagcatctgcggatccttcccccctcagagctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccatgatcgtcctccacgcctgctcgctgcgtagcgtctctgcggcctgcgagtgggtcgtggccatgctgctgttcgcgctcttcggtctcttagccgttgacttctccgccctggagagctgcaccctgtgtgttcagccgtggcccagcctcagccccccgccggcctcccccatctccctgccggtccagctgtagcaggcaccctgacccgggccttgccctcaccagtgaagcaggaaagatggggccaatc

SEQ ID NO: 193647 - DNA, 457 bp, Homo sapiens
  Payload ID: 18235
  Gene Name: transmembrane protein 150B
  ENST ID: ENST00000585918
  CDS Start-End: 1-457
ggatccttcccccctcagagctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccatgatcgtcctccacgcctgctcgctgcgtagcgtctctgcggcctgcgagtgggtcgtggccatgctgctgttcgcgctcttcggtc

SEQ ID NO: 193648 - DNA, 519 bp, Homo sapiens
  Payload ID: 18235
  Gene Name: transmembrane protein 150B
  ENST ID: ENST00000592731
  CDS Start-End: 49-303
ggatccttcaggctccagacacccaacctacccgtggccgagcccggcatgtggggctacctgtcgctgatgcctgtcttcctagctgtctgggctatctctggcgtctggatcgtttttgccattgcagtgaccaacaggactgtggacctcagtaaaggctttccctacatcagcatctgcggatccttcccccctcagagctgcatcttcagccaggtgctcaatatgggagctgctctgggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccagtatccttctttgatcgtcctccacgcctgctcgctgcgtagcgtctctgcggcctgcgagtgggtcgtggccatgctgctgttcgcgctcttc

SEQ ID NO: 193649 - DNA, 576 bp, Homo sapiens
  Payload ID: 18235
  Gene Name: transmembrane protein 150B
  ENST ID: ENST00000591570
  CDS Start-End: 174-576
agccaggccagcagccctagcttctggaaggatccttcaggctccagacacccaacctacccgtggccggatgtctgcctgagccccaccccgaatgccagcccttcttccctgagctcacccagccccagctccaggactgagagccccaggaagcttggagagagcccggcatgtggggctacctgtcgctgatgcctgtcttcctagctgtctgggctatctctggcgtctggatcgtttttgccattgcagtgaccaacaggactgtggacctcagtaaaggctttccctacatcagcatctgcggatccttcccccctcagagctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagc

SEQ ID NO: 193650 - DNA, 878 bp, Homo sapiens
  Payload ID: 18235
  Gene Name: transmembrane protein 150B
  ENST ID: ENST00000586609
  CDS Start-End: 188-379
ttcaggctccagacacccaacctacccgtggccggatgtctgcctgagccccaccccgaatgccagcccttcttccctgagctcacccagccccagctccaggactgagagccccaggaagcttggagaggtgtgagagagacaggtgtccagcctcagccccgatccttcacctgcagagcccggcatgtggggctacctgtcgctgatgcctgtcttcctagctgtctgggctatctctggcgtctggatcgtttttgccattgcagtgaccaacaggactgtggacctcagtaaaggctttccctacatcagccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccatgatcgtcctccacgcctgctcgctgcgtagcgtctctgcggcctgcgagtgggtcgtggccatgctgctgttcgcgctcttcggtctcttagccgttgacttctccgccctggagagctgcaccctgtgtgttcagccgtggcccagcctcagccccccgccggcctcccccatctccctgccggtccagctgtagcaggcaccctgacccgggccttgccctcaccagtgaagcaggaaagatggggccaat

SEQ ID NO: 193651 - DNA, 830 bp, Homo sapiens
  Payload ID: 18235
  Gene Name: transmembrane protein 150B
  ENST ID: ENST00000592603
  CDS Start-End: 139-330
ttcaggctccagacacccaacctacccgtggccggatgtctgcctgagccccaccccgaatgccagcccttcttccctgagctcacccagccccagctccaggactgagagccccaggaagcttggagagagcccggcatgtggggctacctgtcgctgatgcctgtcttcctagctgtctgggctatctctggcgtctggatcgtttttgccattgcagtgaccaacaggactgtggacctcagtaaaggctttccctacatcagccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccatgatcgtcctccacgcctgctcgctgcgtagcgtctctgcggcctgcgagtgggtcgtggccatgctgctgttcgcgctcttcggtctcttagccgttgacttctccgccctggagagctgcaccctgtgtgttcagccgtggcccagcctcagccccccgccggcctcccccatctccctgccggtccagctgtagcaggcaccctgacccgggccttgccctcaccagtgaagcaggaaagatggggccaatc

SEQ ID NO: 193652 - DNA, 1990 bp, Homo sapiens
  Payload ID: 18236
  Gene Name: transmembrane protein 150C
  Uniprot ID: B9EJG8
  ENST ID: ENST00000449862
  CDS Start-End: 320-1069
aaaggcttcggaaggaagcggctcgcccgcccacacccggctcctgccccgggtgactattaggggccccgggggggtggcagaagcccgagacccaggggatcaactctccccgaaggcctagcagcggggaccccagaataagtcgggggcgggccccggcgcggcaggagggggccgggcgggcgggtgagcagatcccaccccttcctgaaggaagcgccctacccgccgctactgctgccgccgccgccaccgcagcaggtcacagcccctcgaggcgacagcggccccgccgcaccagagcagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagct

SEQ ID NO: 193653 - DNA, 403 bp, Homo sapiens
  Payload ID: 18236
  Gene Name: transmembrane protein 150C
  ENST ID: ENST00000454948
  CDS Start-End: 202-403
actgctgccgccgccgccaccgcagcaggtcacagcccctcgaggcgacagcggccccgccgcaccagagcagagtctcactctgtcacccaggctggagtgaagtggagcgatctcggctcactgcaacctccgcctcctgggctcaagcgattctcctgccttagcctcctgcatagctgggactacagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgt

SEQ ID NO: 193654 - DNA, 3296 bp, Homo sapiens
  Payload ID: 18236
  Gene Name: transmembrane protein 150C
  Uniprot ID: B9EJG8
  ENST ID: ENST00000515780
  CDS Start-End: 206-955
ttgtgcaaaaaccctaggtgtgcggacgaaagagagccaggcagaaggttacaacaggtcaggaataaataaccaccaggcggaggatccaagattctgtccttccttttgttggatgaggagcgccaggcaaacgcgtccacaaaggcttcggaaggaagcggctcgcccgcccacacccggctcctgccccggtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagctaagaaaatatcacagaaaaatggaaagaaatatggatgtgcagaggtaataaaaagagctgctgctggacatttatcaaagataggcaccttacagtatcttgttgcaagtccaaatcaggggagactttgttaatatgtatcttttgctcaaatttagtagggttttttttttttttggattaagggcttttcaaatttggaatttgtagaagccaattaaaagaatacccttcctaaaaaccaaattgacacagctggcccccctgctagccaacccgcagttcccagttcccacctgctgagagttcagaactcagaccgtaggtgtgggcttatgagactgtgcttcatgaagaaaagcagaattccaaattcaaactgttggagtgagccaagtggacagaccctccatgagtgcactttcttccaagaaatccccagatttaccccatagaggtctgggattacctggaatataatatgaaaaacattttttaggctgggtgtggggctcacacctgtaatcccagcactttgggaggctgaggcgggcggatcacctgaggttgggagctcgagaccagcctgaccaatgtgaagaaaccccgtctctactaaaaaaaatacaaaattagcctggtgtggtggcgcatgcctgtaatcccggctactcaggaggcggaggcaggagaatcacttgaacccgggaggcaggttgcggtgagacgagatcacgccattgcactccagcctgggcaaaaagagctaaaaactccatctcaaaaaaaaaagaaaaaaagaaaaacgttttttaattcaacccaaagtctgaatttcttgaggaaaaggtcaatgtcttttcatctctgtattgttccccacctcttaacacagtgcctggcacatactaggtgctcaataaatgtctgttgaatagaattattaataatttaagagtaggaaaaaggagtgtcagagagagactcaaagatgagtgagagagcatggaagatggctgtttcatgtgagacaggaatggaagaagttatgaatagggatcagatgggggagtgagaatccctgtaagtaaaatgtgaggaaaagaacaagctgagaacaagattctcctgtcaaaaaggcgtcttactgtaaatagtccaaggtgacatttgttagttttgaatactgcttttgggtttctttttttcatttttatattttaaaatttttatcaaagaacaaagacttatgtagttttcttttattctacacaatccaaattaaacagcttttggtgatgcaattgtacactttcttaagaatatatctaataccacattttagcagaaccaagcaatgactgacattattcattgggatctggccactaaataaaattcttttatgcataattgtta

SEQ ID NO: 193655 - DNA, 566 bp, Homo sapiens
  Payload ID: 18236
  Gene Name: transmembrane protein 150C
  ENST ID: ENST00000508701
  CDS Start-End: 61-423
agcaggtcacagcccctcgaggcgacagcggccccgccgcaccagagcagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttgctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcat

SEQ ID NO: 193656 - DNA, 2562 bp, Homo sapiens
  Payload ID: 18237
  Gene Name: transmembrane protein 151A
  Uniprot ID: Q8N4L1
  ENST ID: ENST00000327259
  CDS Start-End: 145-1551
gccgcgctcgggctcgagctccgcgcactccctccgcggccgctgagccgagcggacgcccccgggggccgcgtcgcagccctccgtgctcccccctatcatgcccggtgcccaggctggggccgcccaagcagccaggacaccatgcccgaggacggcgctggcgacggcggggaggtgcccgcgctcatcccggacggcgagccgctgcgggaagagcagcggcccctgaaacagtccctgggaagctccctgtgccgcgagtcgcactggaagtgcctgctcctcacgctgctcatccacgcctgcggggccgtggtggcctggtgtcgcctggccacagtgccgcggctggtcctggggcccgaggccgccttggcccggggagccgggggcccgccaccgacctacccggccagcccctgctccgatggctacctgtacatcccgctggccttcgtctccctcctctacctcctctacctggctgagtgctggcactgtcacgtgcggtcctgccaggcgccacgcaccgacgcccacacggtgctggcgctgatccgccggctgcagcaggcgccgccgtgcgtctggtggaaggccaccagctatcactacgtgcggcgcacacgccagatcacgcgctaccgcaacggcgacgcctacaccaccacgcaggtgtaccatgagcgcgctgacagccgcacggcccgcggcgagtttgactactcggcgcacggcgtccgcgacgtctccaaggagctggtggggctggcggagcacgcggccacgcggctgcgcttcaccaagtgcttcagcttcggcagcgcggaggccgaggcctcgtacctcacgcagcgggcgcgcttcttcagcgccaacgagggcctggacgactatctggaggcgcgcgagggcatgcacctgaaggacgtagacttccgcgagtcgctcatggtcttcgccgacccccgcagcccgccctggtacgcgcgcgcctgggtcttctggctcgtgtcggcggccacgctgtcgtggcccctgcgcgtcgtggccgcctatggcacggctcacgtgcactaccaggtggagaagctctttggcgccagctcgcccccgccgggggccgtgcccagcgggcccccgctgtcccgcgtggccacagtggacttcactgagctcgagtggcacatctgctccaaccggcagctggtgcccagctactcggaggccgtggtcatgggcgcgggctcgggcgcctacctcagaggctgccagcgctgccgccgctctgtcagcagcaactcgctgccccccgcccggcccagcgggccccgcctgcccttcagccgcagccgcctctcgctgggcgctggcggccgggccacgccaggggtcttccgcagcctgagcggggggccgctggggcgccgtggagaggacacggaacccctggagagcccgccctgctatgaggacgccctctacttcccggtgctcattgtccacggagacagcggctgccagggggatgggcagggtgctctctgagaccccccacggcccccagagtggccccctccccaccattccaccatgggcttagatgcccgagtgattgttgtccaaaacaggcgggaaaacagaccagccacacacaaggggcaggggtgagggtgggggtgggggtccttaaacagactaaaatgcagttacctgtggtcattttggaggaagtggaagcctaagaatcgcccccagcatggcttcatcccccaagatggccgatgatctggcctgaaggcctctcacaaagggcaggagaagaagcttccagaaaggctgggatggaggaggagtcctgcggccagctgttgcctgcagcagaggctgcctgtggacacttccctaccggggctgaggccatgctgggagcccccccagtgacgcagaagcacaaattggaggcttggggccatgcccagccaggttggcttccctggggctgaagagctggctgtggtggcaccatggccttggccctgctactcacccaacattcccatcctcccctgataggcccctcctccttgcctgccctctctcccgctgctcagggccagtcactccccccacatgcagctacccctacaacctggggttccttctcagggcctcacctggtccccacatcccctggcctctgctcctgcctcccaaagtccatgtctgcctccatcagccacacacacgcagggacgcccgttccttgccctcccggacttatctactcttcactttcctgatgatccatggggcccaggcctagagggcatccgaggggctgggccttggccacagcctcttggatgatgtccttgctccaccacgcaggcccttgcttctcccatcaacgagtcttggcccaggggacactgaccctcccccagggaggagagaggagttccttccctttcaacgagggcttccacgccctctaaggggtggcggggaagggaggaggctgagaagatgcagattaaataaaggtatggaatggaa

SEQ ID NO: 193657 - DNA, 4895 bp, Homo sapiens
  Payload ID: 18238
  Gene Name: transmembrane protein 151B
  Uniprot ID: Q8IW70
  ENST ID: ENST00000451188
  CDS Start-End: 278-1978
cgggagcgggcgggaggcggagcggcgccgcgagggcctcaaggtgacacccgcccccggccccggccccccccggcccggccccccagcctgcctcccaccctcagcccccagccccttactcccggtgccctttccgggccccctcccccggcggggggtggggagcagcgagggccccgccccctcccgtcctctccccagggcccgcgcaggatgcccccggcccctggcagccccccgggaggtcctgagctcgacgcgccccctctacgccatgtccccccctggctcggccgcgggagagagcgccgccggcggcggcggcggcggtggcggccccggggtctcggaggagctcacggcggcggcggcagcggcggcggcggacgagggccccgcccgagaggagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtctaccacgaacgcgtcaacacgcacgtggcggaggctgagttcgactacgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcgcgcttcttcgcagagaacgagggcctagacgactacatggaggcacgcgagggcatgcacctcaagaacgtggacttccgtgagttcatggtggccttcccggacccggcccggccgccctggtacgcctgctcgtcggccttctgggccgcggcgctgctcacgctgtcgtggccgctgcgagtgctggccgagtaccgcacggcctacgcgcactaccacgtggagaagctatttggcctggagggcccgggctcggccagcagcgcaggcggtggcctcagccccagcgatgagctgctgcccccgctcacccaccgcctgccgcgggtcaacacagtagacagcacggagctcgagtggcacatccgctccaaccagcagctggtgcccagctactctgaggcggtgctcatggacctggcggggctcgggacgcgctgcggcggggcaggcggcggctacgcgccctcgtgccgctacggtggggtaggcggcccgggcgcggcgggcgtggctccctaccggcgcagctgcgagcactgccagcgcgccgtcagcagctcgtctatcttctcgcgcagcgccctaagcatctgcgccagcccgcgggccggcccggggcccggtgggggcgcgggctgcgggggcagccgcttctcgctgggccgtctctacggctcccggcgcagctgcctgtggcgcagccgcagcgggagcgtcaacgaggccagctgccccacggagcagacgcggctgtccagccaggccagcatgggggacgacgaggacgacgacgaggaggaggccgggccgccgccgccctaccacgacgccctctactttccggtcctcatcgtccaccggcaggaggggtgtctgggccacagccaccggccgctgcaccgccacggctcctgcgtagagacctcactgtgacctccggccccggagtggcccgcgccgtcctcccgcctgcccctcgccggactgtgctccctctgcgacgcagggcgagtcaccacggtgactgaggccgcgcggggggcagggaaagggaggtgagggccgcaagacaggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgcgttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcaccttccgctccccagtcctgcagagctgttgccagggtgcagtggggaggggagtgaaatgtggaggactgtgtacctcagtcctctctctaaactcctcagcctcccaacaggggcctcctcacctgggttctgagtgtataccccttttagagagtgagatgccacccgggcagcactcgttaaagctggccagcacgagtgactaaggggagagagcatgacatagacctgggtggcaacggggacctctggaagcaggtgggagtaagagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgcgaggggcccaaattgtggggataccatggcccatggcttctaaagggtttagctttactttcaggtagagatggctgagtgaggagggagaagaggctagagagagggaggcttgggcaggggaaacagctgcccaccaggttttcctggacagcagtgcccacctgcctactagcactgaacctgcctggaccctgagtctgtgctccttgggggcctggcgtttggagcacccttctttcctctgaatggacatctgtgaggtacaggtggtgagctgcagcctcaggctccatttcttagccagctggcacctggatgtcatgctttgtgtggggacagcctggccacctcagggctccaaggaaggaggaacgtggctcctcctccctcaggcctgttcctgagacagagcctggtctcacaagaggggaagggggacctctattattatttttgcctgtattgaccatttctgcctaggtcgtctcagacagcctcatctcccacacatgcacagacttagagagaaaccaattctttggtctattttcttggtagctttactgattgccagggaaaatgaaaaccagaaaattaattaatctctaaaattaaactttacactgaatgttcttgtttctctaattagaacttctgctagcagctgtggctatacacacacacacacacacacacaccctcacacctacacgtttgcactccggaactgtcagagggtgtcaggcacagacagactctaggttgcctagacaggcacacacatgcagtcactcccaagccccctttggtgctctgctcagcgcctgcttagcggaaggagtccctggagagcaggcactcctggactggggttgtagcccatgacctgccctttggggacacagttctggaggctctgggccaatgaatcagcccaaggaggatgggcaatggcgctcagcctgaatcagtcagctaggtctcttgtggccctgggggctgatgtgattcctgtaggtgtggccccagggtggacagctacagagtgatgggggactcatgtagggcacctggaaggctccatgtgtcctggggacaagggcttgtggggtgggctgggcctggctggggagaagacaggtctctgtcaattgggtgcatcacactgtggcctttttgtcgtggatttaagcgcaaagattgtacaaatcaaactggtggataataaagtcgtggatgactcactga

SEQ ID NO: 193658 - DNA, 1140 bp, Homo sapiens
  Payload ID: 18238
  Gene Name: transmembrane protein 151B
  Uniprot ID: Q8IW70
  ENST ID: ENST00000438774
  CDS Start-End: 1-669
atgtccccccctggctcggccgcgggagagagcgccgccggcggcggcggcggcggtggcggccccggggtctcggaggagctcacggcggcggcggcagcggcggcggcggacgagggccccgcccgagaggagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtaccaggctgcctaggaagccaggtggtgcctttaagatctccatggagaaacgcacagctcgacgcaggatccgacgaagaaccagcctaaaggggttcagagcccagacatgaatccccagcggctcatggtcagcaatatggggagtgggaaggacgaggtccagtgtgtgctcccacctcaaagctctccctctccccattcctcctactggctcaaccagacccacctctcctgttccctccctcctccacctgagacccccagcagcccctgtcctctctgtagcccttccagactcacgggggacctgacatcccagggaagatgccatcagagatgcagacactgagtgtgcggatgtggtcagccaccacgcggtacgctgtgtctgtgcgcccctcgtctgccacccctactcggcccaagtaagggggtgccctgcagccctgggaagcagaagagtcagccagtggccctgcctgacctggcccaggtgggtgctctttatcgcctctagagcatctgccctcagccctaaagccaaccacatccagaatg

SEQ ID NO: 193659 - DNA, 10698 bp, Homo sapiens
  Payload ID: 18239
  Gene Name: transmembrane protein 154
  Uniprot ID: Q6P9G4
  ENST ID: ENST00000304385
  CDS Start-End: 233-784
ggctggagaggcgtgataatagaaccagtgcttcaacagcaacttctcttttgcaatccttgctggtctgacaggctcctgcagaattacatcacttcctaaaaaacaggcacacacctctccttcaagtcagcaccgacccaaacaagcaggaaacaggaaatgttcacgtttcagagaggctgcagcccggcgcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgagggtggagaaggaggcgggtgatgtgctcacttctgatcaacatgtgttgcctcctctcagccaacttctagctcactgaactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccagggggtcagtaagctctgcctgccaagaagacacagtgagaggggtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtaggtaggaagtatgtgcaggtgggagtcatctgtcagccttctatgtttcagagatcctgaaggtggtttgaaacaaacagaagaggagcaggaaatatccgtgcctgtggcagatctcactcatcatgcttagcattctctcccgccaagctgggataagcctcatgtcctaacacagcacaacaggaggtctctgtcagtccatcagagatgacattctatgtgatatttttgacatccttgtgctaaaagcaatggcacaaaatggaaaagggcctattgaccacacctactccagtaaaattgttcttcatttattccttaattttctaaatctgacccctttaaagcaatctagcaaattgagaatcctcagctctccttggatacctgatattttatttcaagaaagagacaaagaaggaaaattttatttattttactacccacatataaaccgaagggagatgggactacccaaacatttgctgctcaattttgtgtcttgtgcttgaaagtctgccctaatgcataacaaaaactacttgtctcctaccttttgggatccctttaacaagtatttgccttctgaactacgtggataatttcaaaggcagagttccagaccagagaggtctttccatacaatgaaagctataactagctggttgtgtttaaccactgctatcacgctatcctgggactgcatagaactttgacaaaagacagacttcatggtacacaacttcaacagattttctgtcatattctcaccagcacatctgaatgaggctttgtgttttccttgctctcttgcatgttccttttcaactcatggcccacagtgactctcagatatttatgccaaaattgcatacaattgttttctgaatcataacttgtctatttttctgcctatgtgtgctactttcagtttgtttctcatcaacattttgactctcagaagagcctccatttgcccctttctctctttaggtatctaagatctttgaacacctgggcctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttatgtttcagactattgttaaaaaaacaaaacaaaaaccaaaaaaaccctcactaatttgccctaattggatagggcaatcagaacaaaatctgactttcgaatatttaaaagatatgtaagtttgattgcattttcgtacattttaagcaaactaggttaacaacaacatagcctagtcaaacttctcaggaaacttgttttaataaatatgtaaaaatacccattcatgactcttgacccaatggtgtgactcctccctctgggaagggctttgttacccaatgcaagaccacagcctggatccaccttgatgtaggtggctcctggataacccacatcaaacaaatgtgataaagatgagtaaaactggtcttgggaaaataatttcatagtttttttttctcctagttatgctgtataatacaggagaaccaaaagctgtaaaattattttattttattttttaaagacagggtctcactatgttgcccaggctggtttcaaactcctgggctcaagcagtcctcctgtctcagcctcccaaagtgctgggattacaggcatgagccactgagcccgaccagctgtaaaattattatattcattttcactatgtgctacttcttctcacctgactttttttttttttttttgagatggagtctcactctgtcacccaggttagagtgcagtgtcacgatctcggctcactgcaacctccgcctcccaggttcaagcaattctcttgcctcagcctcccaagcaactgagattacaggcctgtgtcactatgcccagctaatttttgtatttttagtagagatggggttttcaccatgttggtcaggctggtctcaaactcctgacctcaagtgatccaccagcctcggcctcccaaagtgctggattacaattgtgagccactgtgtctggccacacactgactttcactgtaatatctggatgttttatgtaacatatctgggcaatagggcttatggcagaattggccctcgtggtgtaggccttccaagttccaagtctcatttttagtattcctccgttccaacccctggatccaccagttccaacagcctggatccaccttgatattgacagccaggcagatgcttctgctgatcaccgcagctctagcaatggaaatggatatgttaagaaaatacttgtctattcttttattttggtggtttaaactattaattcacaccatctctgaaaaaaggccttatgttgactaaagaaaacataggctttagtttcagcttctgtcagaattagtaccaattctgaatctggtggagtgataagacatggtttcatgctgggaagacactgctgaaatcctccttgtgggagaacatggaaattttatactgaattaaattaacgcatgtgacttttcacattcagagacattcaggatgaattctggggtttccatttaatagctataacaggcagtccagaacaacttcacatatagcagcatttctgctatgtgacaatgaccaaaagagttcctgtatattagtgtctagtggaatatttcaaattgcagaacccagacaaccaattgcctgaattattattattttttgtttttagcaactctttggctttatcttgatactgtcttgtctggcaccaaagttttatttccttcttagtcctcttggggatagtttttgggtgtttttttttatttttctttttttgagacggggtctcatgctgatgcccaggctggagtgcaatggtgtgattatggctcactgcagcctcaacttcccaggctcaggtgattctattacctcagcctcccaagtagctgggactactggtgtgcactactaggactggctaattttttgtatcttttgtacagatagggtttcaccgtgttgctcaggctggttttgaacttctaggttcaagcaatcctcccaccacagcctccaaaagtcctgggattacaggtgtgagccaccataactggctggaattatttgtacctggaccttgtgttttgtttttttgccctactatcttttctaaataacatatcatgttcctgagatagcagtatatacaattatgtaaaatagagctttatatgaactctgtacatgctctaagctctttttgaatgatattttaagaagtttctaaaccaaagtgcttaagaaaacatgaagatgttaatttcatgaagactgtacaagtttagaagtacaatgtagacctgtttaagacaaaggtggatgggctttggggttttttttacaattggacttcaggtacagaaggcttgggtaatggtactcctcagttcatatcaccttatcattggcctttagtattttgtaaataagtaactggacttttatgaaaagcatattcttaacagtttcccatttcctttttttttttttttaagatagtgttttgctctgttgccctggctggagtgcagtggcatgatcttggctcactgcagcctccacctcccaggctcaggcgatcctcctgccccagcctcccaagtagctgggattacaggcgtgcacaactgcatgcacaactaatttttgtatttttagtagagacagggtttcgccatgttggccaagctagtctcaaactcctgggctcaagtgatccgcccacctcagcctcccaacatgttgggattataggcataagccaccatgcccagccagttttcatttctttggtctgcatgtaaaggactaaagaatgatatgtagctactacactgcagcaaacaacatttttccagtgtacaaatcagtggagagtaagcaatgtattactctgatgtcggtgaaacacctcaaattataaataatgccaggaacatgtgaaaactccacatgtttaataaatgccagctttcagaaaaagcagagattataggtattcaacaagttaaacaataatctggtagattagtaataatttaacacatgtgtatcttgtatttaaagttaactgaaaattatgtaaaaaaaaaaaacactgtgtttgactttcttttgttttacaagtgatgcagagtatctgctgagaaggtcagttagatcatctgatgtcatatttgccacttagcttttgtcccagcagcatataaattctaccttgtaagcctcatattagaagtggtcccagccaggcacagtggcttacttcccaacactttgggagtccacggctggtggattgcctgagctcgggagtttgagaccagcctggccaacatggtgaaaccccatttttacaaaaatgcaaaaattagccaggtgtggtagtacacacctgtaatcccacctactcggggggctgaggcccaagaatcacttgaacccaggaggcggcagttgcagtgagccaagattgtgccactgcactgcatcctgggtgacagagcaagattctgtctcaaagaaaagaaaaagaaatggtcccattgctacggattagaactaatttgtaaaactatcagaattttaagactgattaaaggttttaggtgtttttctcctactttgcatactgagaataatatgtatagtatttttccagtatgatttacaattttataaatgtcagtatacatatgtatatataaattattctcaactccatttttttttaaataaaataagtacatgtttgtgtgctaaattgctcatttggcagtgatagattgaaaaacatttataaatttaaaaataaagcactataagatatgaggaatgaatagcttctatgtgaatttctatgtaattaatatcaatatttagaataaaagtgtatttgaggataagatatttgtttactaaaatgttttatttactaagagtagaggtgaattatgcatctttctaaggaaaagttcttttaatttctgtgtctatgaaaaagaattcataattcataattcttaattgccctcttttgatccatataattctttaaataaacgaaacaataccaattcaaaaaggggcctgctttgtataaaattgtctaacctaaaaattaagtagactttctgcatatctaaaatatattattacacattcttgtctttattcttccttacaaaacatttttaaatgaaggaatgaaattttaattgtttatgagaatataacttttaaaaatatttctagtaggccaggcatggtggctcatgcctgtaatcccagcactttgggaggctgaggcacgtggatcacctgaggtcaggagttcgagaccagtctgaccaatatggtgaaaccctgtctctactaaaaatacaaaaattagccaggcatggtggctgtcgcctgtaatcccagctattcgggaggctgaggcaggagaattgcttgaacctgggaggcggggtttgcagtgagtgccaagactgagccactgcactgcaggctgggtgacagagtgaaactccatctcaaaaaaaaaaaaaattctagtaaaaatggaaaaatccacaagaaaacctctttttttcctgattactcacttttcttcatgcctttaattttaacctcatctcacaccttgatattagaagaaagtaaggctgaaaggcagattcataagttgtagataacatgaagacttccttgaataaggatttattctttcggctcacaaagaccagtcagtattattgacaaacaacaggcaggaagatttctcctaaaagtctcaactaaagttaaacctggtccattatggcatcaatctacccctagaaactgatgcagagtctatttcctccctgttttaactagaacttagccagactggagacagcatggacccaaagagcatgcagtcccacagagttagggaaaggatgcatcttgaccagcattcatcatgtggatcagttaggaattaagttcctgattcaaggtgagctcatatggccgctccctggtcatctaggacacaagttccttctaactcttccccaccttcattagtacagggcttctttcctgtgttgccacatgatccaaaatggtggttgtaactccagcatgatattcacaagaaggaaagagagggaaccagcacaagggtgagcctcccaagtaggtcagccacttttaaatagctttcctgccagcccagtgaagcaactctgcttacatctcattggccaatctctgcaaggcagcagggaacagtcatctctatggttggtacattatcactttcaacaataagggattctgtctcacaaagtggtggaagaatattgggtatctgaagaggtagccaccctggccagaaggtgctaaacactaaacatacatcatctcattttaatcctagtaattacttatgaggtaggtttagagaacttataccttgttccatgtctttccaactccaaagcacaagtttttaatcactgcactgcactgcatccccaataactagccgtaggaaagtgttttaaaaggcatcacttggcggggtgcagtggctcacacctgtaatcccaccactttgggaggccgaggcaggcggatcacctgaggtcaggagtttgagaccagcctggccaacatggtgaaacccccgtctcaactaaaaatacaaaaattagccaggcatagtggcatgtacctgtaatcccagctactcaggaggctgaggcaggagaatcacttgaacctgggaggcggaggttacagtgagatgagatcacaccattgtactccagccttgtctaaaaaaaaacaacaaaaaaacaaacaaaaaaaagtttcagtcattgtcaaggatgccttaaggtgagcatagcctgagataagaagtaacagaggctgcaggctgagataagaaggaacagaggcagtgaaggcaggaccctaggcccagaagtaatggtctatcatgctgagaaaaaagccagggcttagaataggggtgataagtaaaaagcctagttttaaaatctaagtgctggtaaaggtttggtcactaggtgaaaaaataaagttcccacttactagagctgacataaacagcatatgatcctctttaaggttgcagtggagaggcatgtccagggactctcaagttagagacaggtgtgtttagtgctagaattggaaagacattcaagcagactggcatgttgcctcttcacagccatagtcgtgctggcttgcaggatactccagcctagaatgtatataggagtgtggagaacagcaaaatcagcattgcttgggattcagcctgagctcaagtggcccacccctggaggcatccagtgttcacacttcccaagagagaaaacctgattggatgggtgtttcagcagtctattgctgcttaaacacctcaaaacttagcagcttaaaacaacaacactcaatttatttttcacacaaatctgcaatttgcatgaggctcagtgcaaatggttcaactctctcccacacggcattggctgggcagttcaactggatctgggggtcccactttcagatgactcacatggctggcaagtttgttctggctgtcggataggagcccagccaagcctgtggtccagcggccttggcttttatgatgtgggcctctccatagactccttgggcttcttcacagcatggcagctgagttccaagagcaagtgtcccaagagagcaaagtagaaatgcatagtatttttataatttagactcagaaatcacatcacatcacttctgccatactttattgtttgagacagttacaaagtctacctaggttcaaggtggaaaggacataaaccccacttgtccttggaggcgtgtcaaagccacattatgagaagagcaagtgggataagggatttgttgcaggcaccgttggaaaatgtgatctgcccaaattggtgtgtcttcatgcaatatcgaggaaatatattaggtagtttcgtgtcaaggaacattgtggatatttgacctccctgaatcccagtgcctatgtgctctttggcttggacatagacccctggtccagtagtctgtagtaggtggtagaactagttttaccaactacatgagtcatgagccatgggactgaatgggttgtaggtggatcagacacatagaaatgtatgactactctcaaagcatgaggttaaaatgggagcagattagactgagcaccttgaggatagggatcagtcttactcatctctgtatcctgaaaagtgcttggcgctactgcacgctccataataacagaaaaaccaattatttaatgagctaggagttacatatcatctttccttaagtacctaatcagtctttatcatcagtgagtgcagaactcaaatatggtattgttcatcttccatcaccattttctcccaagtttcctggtttaattgcattttcctcactttccatctaatggatcctgatgtcattctttatctttatttcatattgtcctattgtgtgtattgtattgtatttttagctacattaaatccaatatggaaggaagcagagaacgatcataattgaactaacaagcaagtggaggtggagagaaagtggccccaatttggaaggtgaaggaaaactggggatggagcctaactgatcattaaaatgctcgaagcagctctttccaa

SEQ ID NO: 193660 - DNA, 878 bp, Homo sapiens
  Payload ID: 18239
  Gene Name: transmembrane protein 154
  ENST ID: ENST00000504064
  CDS Start-End: 80-457
aaacaggaaatgttcacgtttcagagaggctgcagcccggcgcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatacctcctggtatgaaatttgcagtgtcttgatgtgtgaggtctctctgaaagagctgcagggaaaacagcgggcgataaactacccctttaaacaggctgtggctacatgatgcctggcttactcagtaaatcttctggaaagagactctttctcttgctcactgctcagcgtggaaacaagaaaaggaagccagaggctcctgtagctcctgccctcccctagcctccaccagacaaccccactatcgaatgcacagaggagaggatctgagaggagagtactgtcaggctaagtgggggggaagtaggaactgaaggaggaggacaaagtgggttggaggagatgaaatggaaggattgttggagggaaaatggaataggggtttgagatggagctttgtaagagctgcatttgcctcctggttgcaaaggga

SEQ ID NO: 193661 - DNA, 486 bp, Homo sapiens
  Payload ID: 18239
  Gene Name: transmembrane protein 154
  ENST ID: ENST00000613578
  CDS Start-End: 1-486
ggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagagattccaggtca

SEQ ID NO: 193662 - DNA, 2313 bp, Homo sapiens
  Payload ID: 18240
  Gene Name: transmembrane protein 155
  Uniprot ID: Q4W5P6
  ENST ID: ENST00000337677
  CDS Start-End: 560-952
gggtgtgcgggcggcgcgctcgccctccagctgcagcccgcgccgagcgcgcagggccagcgagcgccggcgcctccagcatggagtgggaactcaacttgctgctctacctggcgctcttcttcttcctgctcttcttacttttcctcctgctcttcgtggtcatcaagcagctgaagaactccgtggccaacacggccggggcgctccagcccgggcgcctctcggtgcaccgcgagccttggggcttctcccgagagcaagcggtgtgacccgagtgcgggcactggcgggagggcaccgagctgcgcgggcgctgggctgggtctccgcctcgattctccgtcctcgcggcctcccagcttccagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatgatggtggatcttgggaggacaactaacattttatgccctggctacagaatacagttgcagaggagcataaagttcaaaaagatcaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgtaacaca

SEQ ID NO: 193663 - DNA, 1753 bp, Homo sapiens
  Payload ID: 18240
  Gene Name: transmembrane protein 155
  Uniprot ID: Q4W5P6
  ENST ID: ENST00000394394
  CDS Start-End: 431-823
gctgttacctcttctggcgtccgtgcccgcggaagttcgctcctagggaagtcgctcgcgtcctcaagagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatgatggtggatcttgggaggacaactaacattttatgccctggctacagaatacagttgcagaggagcataaagttcaaaaagatcaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtggg

SEQ ID NO: 193664 - DNA, 2032 bp, Homo sapiens
  Payload ID: 18240
  Gene Name: transmembrane protein 155
  Uniprot ID: Q4W5P6
  ENST ID: ENST00000394396
  CDS Start-End: 279-671
tttggagggaggaatcccttcctcccggtgatccttactcatattctagccaccaaccacggttagtgcttgcggattgccgtgcaggagccgagctgctgcccttgactggtgctcaggggaccacagctgcaatgacagtttgggcctgcaaaaagaaggctggaacaacgggagatggaagctttctgcaaatgcagcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactaggttccaagatggtccccgcagcaccccacaagaagaaggaggaagcccacagagaaaacggggcatgccagttcaaatccacttccttttaaagagcttcctcagcagcccaataacttttgccttcatctcattggccagaactgtgtcattggctactgctatctgcaagattgtctgagaaatgtagtttttgtagctggatatataactgcctttgacaaaaatccagtttctcttgatgaagaagaagatgatggtggatcttgggaggacaactaacattttatgccctggctacagaatacagttgcagaggagcataaagttcaaaaagatcaaaactctagttccttcacaactgtcaaagctccaagcagcactgctcccctctgacagagtgagcagagtgaaggcatgtcaggtgttctcacaaaactcttgacagggctgacctctctcagtcaatatccttgtcccacatcaggattttctagagggccctgggtacctgtgcacttccttggtggccgtaacctctttgtggagggttggtgtaggataaagaatgttctattacgctgctccctcatctgtatcatttctctcctctctaattttcctgtcagttatattttggtggagtctgggtttgtgtatttgattcctatagaaagaccatcgctttcatgcatggaggaggggaatctacgcaaagaaaggctaccttactcctttctgtgactccaccaccagtctaggaatatcctgggagaagaattgcctctcaaagctgcttctataagcagcctacatcctagctaagcaaagaagaaacacttcccacatctagggctgtctaaaagaactttctgtgatgacagaaatgttctatatctgcagtgtccaatatggtaaccatataggcacatgtggctagtgaacacttgaaatgtggctagtgtgactgaggaaggaaaatttaaattttgtttaattgtaattaatttaaattcagatagccaaatggggctactagctattgtgttagatagcacggtatactttattctctttcttgtgttgtagaaccagctgggagaggtgtgggtcagtcatgggcttggtatcccctggtcttcactattctagcttgccattgaatttgtctcccagaggaaaagaaagaatggtatttggaattaaattcaagatgttaacttgacatctatatattgcacatattcctgtatagtgaatggatgacctcctgggaatagttcctgtgactgattttagtgataattgatcatgaagaaatggcagtactgctccacttcaccttcctagtgactattatgtgttcctagtcagagtgactcagcagagattattttgttctcttgtgcaatttattctgtgtcattttatttttgtaatattgtggcagctaaatgattattctgtgtatgtttttcaaaatattaggtggcttatattttttaaaaggctatgaaataaaaataaactatacgtaacaca

SEQ ID NO: 193665 - DNA, 573 bp, Homo sapiens
  Payload ID: 18240
  Gene Name: transmembrane protein 155
  ENST ID: ENST00000514885
  CDS Start-End: 362-573
agagcacctgagaggatctcggcgaagcggaaggctttggtgccagctgggagagtctgcgccggatttcctcagctccttggcgcgtttcctcggagccgggggaggcaaagcacggaccccggagtcggcgcccatagcgggacgccctcgcgaggggcgggagtgcgggagagccgagctgctgcccttgactggtgctcaggggaccacagctgcaatgacagtttgggcctgcaaaaagaaggctggaacaacgggagatggaagctttctgcaaatgcaccactggtatccatgaatttaacctgcccatcattcttcctaaacaagagactattgaaaagtcagggtgttcaaaatggcttcagatcttatcaggacaatcttggctgttgcactaatttccaaacttggcacagctgtagatgcagaactgatgccatctggtgcgattctacagaataagagagaaaatttacccagagtgtgccatgcactggcttttctgggaatggcaaggtgccaggatttgtttttggttcgcttgcaggggtggaaacttggaactag

SEQ ID NO: 193666 - DNA, 949 bp, Homo sapiens
  Payload ID: 18241
  Gene Name: transmembrane protein 156
  ENST ID: ENST00000344606
  CDS Start-End: 412-949
tctcactctgtcacccaggctggagtgcagtggcctgtcatggctcactgcagtctcaaatttctgggttcaagtgatcctcagcttcctgagtagctgggactacaggagtgcaccaccacacctagctatattaaaattatttttgtagagaggagggcttgctctattgaccagtctggactcaaactcctgaactcaagtgatccttctgccttggcctcccaaagtgctgggattacagatgtgagccacttcgcccagcccaccgttttattttttcttactcaaaaggaagtgagtatgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctagagatggatataaaaagta

SEQ ID NO: 193667 - DNA, 1935 bp, Homo sapiens
  Payload ID: 18241
  Gene Name: transmembrane protein 156
  Uniprot ID: Q8N614
  ENST ID: ENST00000381938
  CDS Start-End: 109-999
atgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacaggtgaatttaaaatgtgctcctcgtgtttggtttgtgagtctaaaggaaacatggattttatttctcaggaacaaacatcaaaagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctagagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagcacagagtggagccaagtttttaattttgaggaaccaaaaacaggatcaaatatgaaaaccctttcttttattgggccacattgtagatgctgatttgataattgtttcctatgcagatagattatttttatttcacagattatttaaaagggaagagggcctggttgtttatttatatgtttgtttgcatttatgaatcttgctgccttttagcaccaggatgtttttaaaaaaattcaaagaggccaggcgcagtggctcatgcctgtaatcccagcactttgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaatcaaagataccaataaaacgaatttaaataaaatacttaagtactttaatagcaaaa

SEQ ID NO: 193668 - DNA, 1813 bp, Homo sapiens
  Payload ID: 18242
  Gene Name: transmembrane protein 158 (gene/pseudogene)
  Uniprot ID: Q8WZ71
  ENST ID: ENST00000503771
  CDS Start-End: 252-1154
cggcagcccaagggccccggcgccgggggcggcggggaaccccaaacgcaaccgggtctggagggatccccgcgccgagccagccgccgtcaccgcctccgcgccgcccctgcgggcttggcaggcgcccggcgcgcccgcactgcgcccggccgccggctcccgcggtcccaccgtgagctcgccggcccgtcgcccgctcgccatgcaaccgccgccggcctcgcgcgcgtaggcgcccgccgcaggccatgctgcccctgctcgccgcgctcctggccgccgcctgcccgctgccgcccgtccgcggcggggccgcggacgcgcccggcctcctcggggtgccctccaatgcttcagtcaacgcgtcctccgcggacgagcccatcgccccgcggctgctggcctcggcggcccccgggccccccgagcgcccgggcccggaggaggcggcggcggcggcggcgccgtgcaacatcagcgtgcagcggcagatgctgagctcgctgctcgtgcgctggggccgcccgcggggcttccagtgcgacctactgctcttctccaccaacgcgcacggccgcgctttcttcgccgccgccttccaccgcgtcgggccgccgctgctcatcgagcacctggggctggcggcgggcggcgcgcagcaggacctgcgcctctgcgtgggctgcggctgggtgcgcggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggagactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctcca

SEQ ID NO: 193669 - DNA, 2014 bp, Homo sapiens
  Payload ID: 18243
  Gene Name: transmembrane protein 159
  Uniprot ID: Q96B96
  ENST ID: ENST00000233047
  CDS Start-End: 469-954
tgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaa

SEQ ID NO: 193670 - DNA, 1812 bp, Homo sapiens
  Payload ID: 18243
  Gene Name: transmembrane protein 159
  Uniprot ID: Q96B96
  ENST ID: ENST00000261388
  CDS Start-End: 274-759
gttcctcctcctgcctctcttcgcttcgcctgcaaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttccc

SEQ ID NO: 193671 - DNA, 1378 bp, Homo sapiens
  Payload ID: 18243
  Gene Name: transmembrane protein 159
  Uniprot ID: Q96B96
  ENST ID: ENST00000451578
  CDS Start-End: 157-714
ctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaat

SEQ ID NO: 193672 - DNA, 584 bp, Homo sapiens
  Payload ID: 18243
  Gene Name: transmembrane protein 159
  ENST ID: ENST00000572258
  CDS Start-End: 185-457
tctttccttcttcctcttgttcctcctcctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggccactgacacagcaaaacaccagttgtgactttctgccagccatgaagtctgcagaattcgaggggctttaccaggaatgagtgactgctcagaggccgggcttcttttcaagtactgctggatcatactcacc

SEQ ID NO: 193673 - DNA, 1495 bp, Homo sapiens
  Payload ID: 18243
  Gene Name: transmembrane protein 159
  ENST ID: ENST00000573688
  CDS Start-End: 1-295
cttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccagatctctttcatatctgccttaacagttgtcagccggcttctcgtttgtgtggctgcattcattctgttgtgctatgttgtcctgtttggagtatttgaagaagacctagcatcactaacatgcggttgggagagggaggcaaagcttttttaaacgattgtggatattctatgatagtccaccaaaactccgccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttttgtgacggagtttccctcttgttgcccaggctggagtgcaatggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtg

SEQ ID NO: 193674 - DNA, 713 bp, Homo sapiens
  Payload ID: 18243
  Gene Name: transmembrane protein 159
  Uniprot ID: Q96B96
  ENST ID: ENST00000572599
  CDS Start-End: 172-657
cgcctgcaaacgcggtgggggctgctcggcggtcaggagcaggttaccctccgtctgcatgcccaccatcaagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagaattcgaggggctttaccaggaatgagtgactgctcagaggccgggcttcttttcaagtactgctggatcatactcacccct

SEQ ID NO: 193675 - DNA, 305 bp, Homo sapiens
  Payload ID: 18243
  Gene Name: transmembrane protein 159
  ENST ID: ENST00000577162
  CDS Start-End: 167-305
gcaaacgcggtgggggctgctcggcggtcaggagcaggttaccctccgtctgcatgcccaccatcaagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggag

SEQ ID NO: 193676 - DNA, 1593 bp, Homo sapiens
  Payload ID: 18243
  Gene Name: transmembrane protein 159
  ENST ID: ENST00000573487
  CDS Start-End: 469-960
tgtcttgaaggtggtctgagctttctcactccaagccagtcgtgtgggaagggacactctctgagcctcagtttcctcagctgtcaacctctcagggcttgttctagtggctccgaaagccagtgggagcgagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggtctcacgagatctgatggttttataaagggcatttcccctgcacatgctctcttgcctgccgccatgtaagaagtgcctctgatcttcctttgccttccaccatgattgtgaggcctccccagccatgtggaattgccactgacacagcaaaacaccagttgtgactttctgccagccatgaagtctgcagaattcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaa

SEQ ID NO: 193677 - DNA, 663 bp, Homo sapiens
  Payload ID: 18244
  Gene Name: transmembrane protein 160
  Uniprot ID: Q9NX00
  ENST ID: ENST00000253047
  CDS Start-End: 17-583
ggccgtagtgcgaatcatgggaggcggctggtggtgggctcgggccgctcgccttgcccgtcttcgcttccggaggtcgctactgccgcctcagcggccccggagcgggggcgcccgggggtccttcgcccccggccacggtccccgcgccggggcttcgccgcccccagtgtccgagctggatcgtgcggacgcctggctcctccgaaaagcgcacgagacagccttcctctcctggttccgcaatggcctcctggcatcgggcatcggggtcatctccttcatgcagagtgacatgggtcgggaagcagcatatggcttcttcctgctgggcggcctgtgcgtggtgtggggcagcgcctcgtacgccgtgggcctggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctccaga

SEQ ID NO: 193678 - DNA, 1820 bp, Homo sapiens
  Payload ID: 18245
  Gene Name: transmembrane protein 161A
  Uniprot ID: Q9NX61
  ENST ID: ENST00000162044
  CDS Start-End: 66-1505
gagtttccgcagagtgcccggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggctctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcaagggtgatgctggctgctcttctgaacaaataaaggagcatgccgatttttacaaaca

SEQ ID NO: 193679 - DNA, 1930 bp, Homo sapiens
  Payload ID: 18245
  Gene Name: transmembrane protein 161A
  Uniprot ID: Q9NX61
  ENST ID: ENST00000450333
  CDS Start-End: 39-1169
aggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctgggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggctctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcaagggtgatgctggctgctcttctgaacaaataaaggagcatgccgatttttacaaacagggtctgagtggtttgggactcgggcttgtgcagggtggtagctgtcttgcacgtccctgtggcacctgcccgggtgcagggtgggggctgcgcgggagggagagaggagcaggactgagaggggagcaaaggtctgggaggagaaaggagagcaagaaggaggccaggctcggcggctcacgcccgtaatcccaaatcccagcactttgggaagccaaggcgggcagatcacttgaggccagcagtttgagaccagcctggtcaacgcatggtgaaacccagtctttactaaaataacaaaaattaggcatggtggcgcatgcatgtagttccagctactgagaaggatgagccagaagagtcgcttgaacctgagaggtggaggctgcagtgagccgagatcgcatcacactccagcctgggtgacagagtgaaactctgtctc

SEQ ID NO: 193680 - DNA, 789 bp, Homo sapiens
  Payload ID: 18245
  Gene Name: transmembrane protein 161A
  ENST ID: ENST00000590216
  CDS Start-End: 26-148
agtgcaccgcgttctcgcacgcgtcatggcggtcctcggagtacagctggtggtgaccctgctcactgccaccctcatgcacaggctggcgccacactgctccttcgcgcgctggctgctctgtaacggcaggctaccctctaactagaatccctggatttggggttcactgcctcaacctcccaaccccacgcctgagcttccctgactgcccgtccttgctctcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggc

SEQ ID NO: 193681 - DNA, 582 bp, Homo sapiens
  Payload ID: 18245
  Gene Name: transmembrane protein 161A
  ENST ID: ENST00000587925
  CDS Start-End: 1-582
gagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagg

SEQ ID NO: 193682 - DNA, 1654 bp, Homo sapiens
  Payload ID: 18245
  Gene Name: transmembrane protein 161A
  ENST ID: ENST00000587583
  CDS Start-End: 20-1384
ccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggctctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcaagggtgatgctgg

SEQ ID NO: 193683 - DNA, 1065 bp, Homo sapiens
  Payload ID: 18245
  Gene Name: transmembrane protein 161A
  ENST ID: ENST00000587096
  CDS Start-End: 120-1065
taggccggtgggtgagtgcaccgcgttctcgcacgcgtcatggtgctgccagtcatgtcccctccccccaggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggcccc

SEQ ID NO: 193684 - DNA, 540 bp, Homo sapiens
  Payload ID: 18245
  Gene Name: transmembrane protein 161A
  ENST ID: ENST00000587915
  CDS Start-End: 106-540
gagtcgggctctaattggtcgagtttccgcagagtgcccggagccctaggccggtgggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgag

SEQ ID NO: 193685 - DNA, 1754 bp, Homo sapiens
  Payload ID: 18245
  Gene Name: transmembrane protein 161A
  ENST ID: ENST00000587985
  CDS Start-End: 35-1012
cggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggctctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcaagggtgatgctggctgctcttctgaacaaataa

SEQ ID NO: 193686 - DNA, 528 bp, Homo sapiens
  Payload ID: 18245
  Gene Name: transmembrane protein 161A
  ENST ID: ENST00000592369
  CDS Start-End: 345-528
aattggtcgagtttccgcagagtgcccggagccctaggccggtgggtgagtgcaccgcgttctcgcacgcgtcatgtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtgg

SEQ ID NO: 193687 - DNA, 2594 bp, Homo sapiens
  Payload ID: 18246
  Gene Name: transmembrane protein 161B
  Uniprot ID: Q8NDZ6
  ENST ID: ENST00000296595
  CDS Start-End: 126-1589
ggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttca

SEQ ID NO: 193688 - DNA, 1796 bp, Homo sapiens
  Payload ID: 18246
  Gene Name: transmembrane protein 161B
  ENST ID: ENST00000512429
  CDS Start-End: 272-1702
ctctttcgctgtttgagagtctctcggctcaaggaccgggaggtaagaggtttgggactgccccggcaactccagggtgtctggtccacgacctatcctaggcgccatggttgcaaagaagaatgtaatcttgtagagtaccttgccttcccttccatacattcagcagacatagttcctttaagggattttactgctaggagaatttcataggtcatattcccatgttactgcttcacagggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatac

SEQ ID NO: 193689 - DNA, 2328 bp, Homo sapiens
  Payload ID: 18246
  Gene Name: transmembrane protein 161B
  ENST ID: ENST00000506536
  CDS Start-End: 504-1157
gctgtttgagagtctctcggctcaaggaccgggaggtaagaggtttgggactgccccggcaactccagggtgtctggtccacgacctatcctaggcgccatgtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaattagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttc

SEQ ID NO: 193690 - DNA, 2804 bp, Homo sapiens
  Payload ID: 18246
  Gene Name: transmembrane protein 161B
  ENST ID: ENST00000511087
  CDS Start-End: 77-442
aaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttaggaggccttctaaaaaatgatgttgatgttttggactacactctggtagaagtaaaccagaatacctatgccacctgagatgcaaaggcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacagtaagcggaaaataactttacttcatatcaacttcttggcacctttatttatggttctgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcagcagagtaagcaatttatttgtgttgcctatgtgtgagtgtatttaaagttttatggacgcttaatggtttctcccaaattaaaattctttttctgtcatttccaaaaatcagaatctttccctctcaaatcaggtctacaggtatcatgtatgccttt

SEQ ID NO: 193691 - DNA, 7608 bp, Homo sapiens
  Payload ID: 18246
  Gene Name: transmembrane protein 161B
  Uniprot ID: Q8NDZ6
  ENST ID: ENST00000510089
  CDS Start-End: 403-825
ggcagagccggaagaccctctctttcgctgtttgagagtctctcggctcaaggaccgggaggtaagaggtttgggactgccccggcaactccagggtgtctggtccacgacctatcctaggcgccatgtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacagtaagcggaaaatgtacataagcacatgcagataaatatatgttttccatcttaatgaagaactttacttcatatcaacttcttggcacctttatttatggttctgctctgggtaaaaccaatcaccaaagactacattatgaacccaccactgggcaaagaaagtatccctttgtaagtatgggcatttgagggctgatttttatcaccaaaactgctttactaaatgttatttactgtatttcgttttcagtgataaaatcaggacactgtatttttcagacattaataggaatgctaaaagatgtgttagaaaattgaaactacagaccatcatgtaacatttttgtgatctttattagttaatgttaatgattattaccttgcactaatattaccttacacactatttttttcctcctctttatgtccagtcgtcatcatttttctgttgtcattgtggctattgttcagataccttctggagttcttttgttttaattttgaaaattatggaggaaaaaagtataaatggaaactcatatactcaactcctatgtttgacagttgttaacattttccatatttgcttcatccattctttgttttgttttttgatgaaggatttttgaagtaaattagagacataacagttttatcccttagtactttctttagtttgcacctctaaaaaaaataaggatattttcctatataacaataacatcatcgtacctaacagttatctaatactaataccttaatattattatctaatactagtttatatttctacagttaggcaactgtattttagcagaagaagatggtgaggaaacaaacagtttattaataggcattaataactagacttgatctgttagccttgtagaactgttagagtaatagaaagtttcagacagaactggttcaaactccagctctcctcctcactaaaatcttcatttgaggcaggttatttaacttcactgagcctctgtttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatacttgactagtcattgactccgcagtgtaccttttgtattgtgtccttcttttagatcctggtaccagtttgtcttggaatatatataaaatcagtgatgaccatgataatttctctttttagagttaatcctattgaacccaggaaatagccactgaaaaagtaatgcttccccgccgccgacacacactaattaccttaatggtaatttaacttgacagattccctaagtattgaaaagtaattctaaggatctaaggttctagaaaagtctcagagaaactactaattcatatctttgatactgaaagcattcccaatccttccttgagattttggtcatggaaactggatttcatactcctgtaactatgttccctgatttttatatttgccttagttaaattgagaaaataaggaaactagcatttataaaacacttatataccagttattatgtgagatattcatactttacatattgtatcttcttatggtaattgtccatttgttgctgttgtcatcctattttatacatgaaataacaggctcagaggttaaataatttgactaaggttattcagccagatcgcgtgtacataaaacacttggtagttataccaacattcacttcccacttccagtctgattaaacttcatgtggatttattagtaatgaatactttatttaatagaaatgggaataaggaacttttcccttgtgtgtatattaaattataggaaaaatattgtttgtatataaagacctgaggttctctttctatagctttttcccccctttgtcccatccccatttctgacctgtttcataagcattccaagcaaaattatagttttacctctgctctcttttattcttctttaatttgaattcgtggttaagttattagaggcagtttttaatttttgttaaaaatctaaaatgcatgtgatagattgtgaaaaaatggctgcccatcaaagagggtaggatgaaggaaaaataaagtgacaggttcttcttctgtcacagacaaattggtttgtggaaaggtctttgtaatcagaagcaaaaatatggtataatgtagtttcaacccagaaatgtgtttgagtccatcatgtgttctgataaagcattgaaaaaaataaaatatggtaaacagagtccatgtgtgctcataatctcctaagaagaacacagcatatacaggaaagctcagaatggcatcaggaatttaaggtggtttcttctgcctgttctttccctatatactttaagctcctcctcatgctccttcttgagatactctatcagatcaacttcttcagatatttatgatggtatggaataatctaattagaaagtactatttaatgactattatcctaaatcctcaactcataaactgaacaaataattttctagttcactaccttattctgttcctttcattcacgttacctgttatcctcaaaggctgtgaaatagctgtcttcaggctgctcccagttagttgtccttgttgcacaactggagggagcacagtattgtttataggtccccaggaaagggtcaaggctgtgggtaggcttgtgtcttacgtactgttactctcacatgatggctcctaaatctcattgttcattgtagtggaaacatgttgataaaatgttatgcctttatctttcttagccaacattgcttttccattgaaattttatgtccatgtcccctcatgacttaataaaaagaaatgagagagtatatatagtaaagcctttgtcccatccccatttcttacctccatttcataaacagttcgagcaaaattttacacttcaaattttcctatattgtagttttagttatgagggttttttttttaatcttttctcatttgttctttatatgcatccattctaccgtcatgttcttaagaatttcagggagacccttctgagttccaggttttatctggcaaatgagtctgtgcattacaatagtcattttaagtgcctgataggtactagatataagactagatgccaagggtggtctagtcactacattcaaattacttgcaatgtagttcttcatcagagcagaaacccatggtcttttaaaaacattaaacaccaaaaggacatcagaagttatctcttctttctaaaaattctttaagcagccctcatcagtggtctggtttctgaaatggtgtccttccgttatgtattttcacctggaatcttaaccttaaccttgaggaattgctcagaaccgagccagcttcaacgcatagcaagttaaatgaattgttgtagaggaatctcaggcacctgatttcttcatgatatatcagaatttttgattttccagtggtcccaagtaaaagctcagcagattgaaagatcccatccaagtaggtatatgatcaggcaaagctgtaaccagtgatgctgggtgattgacttgattagtcccacaggcaatccctgcagttttctttctttccccaacttgtcttttcatgtcacagccagtttttatccatggaggagggtatatagagaaaaggatctcatgtattgctctacttttttcttctagatacctgttaacttcttacgctttcatgatacatttatctagttctgttattcaagttaaagtattatacagttaagtctatggcagagtcagattcttttatgtgtctaactgttgcgaagtatagacttcttatatcttatatggtgaccattaacatataacgagcatgctagcatattgttgtctttgagagcaccgtatcaactttttgatctgtagaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtaagttttataccctagtcaaaatgaaaaatagcaaaaaccgcactgtaaaaaaaaaaaaaaattggtttcctttagtagatagtatttcaacccatcatattcttattataaataaacagaacaatcttaagttgacagatatcaaagagaccttgatctgattttggtgccaagtgaggtcttaattcctcttcctgccttaagtgcttggtgtcatacagtgggtggtacaaagctgttttatgcctaatattgctaaatgggacccttctaattgatttgaaagacattataacatattgtccagactttaagacttaaagagtaggaaatactacttttagtggctaaatttattcattttaatattactcaatttacttgaacatgaaatgtaagtatttaatttatttgaggcttccagagaataaaaggacaaggaatccatctgccactatagtggaccaataacctcattctttttttaagagaggtggtttttggctaccttgctttattattattattgttattttattttttgtagagacagggtctctctgtgtagcccaggcttgtcttgaactcctgggctcaagtaatcctcctgcatcacctcccaaagtattgggattacaggcgtgagtcaccacgcccaaccagcttcagtttttgattcacctccatagttaggggcatttattaagatttaaacaacttttttctgttttaccttttatatatttttatattttccatagtttgacttcaaatatgttcatgtagaatggggacttaatgtttttatttatgagggatttatgctcatatgtggctctgcctactattgttatttagttggatattttaggtagatgcccttacattgtgttttatctttgaaatataagtaaatatataccatttgaatcttagtcattattttctccaatatatatacatcatttaagaattatttttaaggaatctattttaatattctcacgttctaaaaacttgtcttcaaattgagcctttccaaagtcattttggggacatgtatcatgcagcacaacttactgacatttagcttccttcttgtgaaaggattatctcttaagtattttggtatggcaattatatgaaagtttaattcactcctaacatgtcagttgcattagacacttaagaatgttgttggttgcaggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcagcagagtaagcaatttatttgtgttgcctatgtgtga

SEQ ID NO: 193692 - DNA, 963 bp, Homo sapiens
  Payload ID: 18246
  Gene Name: transmembrane protein 161B
  ENST ID: ENST00000509387
  CDS Start-End: 412-948
acaacttccggcagagccggaagaccctctctttcgctgtttgagagtctctcggctcaaggaccgggaggtaagaggtttgggactgccccggcaactccagggtgtctggtccacgacctatcctaggcgccatgtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttgtaagtatgggcatttgag

SEQ ID NO: 193693 - DNA, 1351 bp, Homo sapiens
  Payload ID: 18246
  Gene Name: transmembrane protein 161B
  ENST ID: ENST00000511218
  CDS Start-End: 132-968
ttttatgaagcctacacaggaaatgaatatcagcttagtctggtgcctacttgttttgtcttttgcaattagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatcccttttcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagt

SEQ ID NO: 193694 - DNA, 2035 bp, Homo sapiens
  Payload ID: 18246
  Gene Name: transmembrane protein 161B
  ENST ID: ENST00000514135
  CDS Start-End: 108-1616
tctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaagcataatgcaaggcaaggtccagccgttccacccggcatgcaagcttatggagcagccccctttgaagatctccagctagacttcacagagatgccaaagtgtggaggtaacaagtatttactagttcttgtgtgtaccttctctgggtgggtggaggcttatccaacacgaactgagaaagcttgtgaaataacccatgtgcttctttgagatcttattcctagatttggactgcccttacggatcggctcagataatgggctggcgtttgtggctgacttggtacagaagacggcaaaggtactggggatcacatggaaactgcatgctgcctactggcctcagagttccggaaaggtggagcggatgaatcagactatcaaaaatagtttagggaaagtatgtcaggaaaaaggattaaaatggatacaggctctccctatggtattatttaaaattagatgtaccccttctaaaagagcaggatattccccttataaaatactatatcataggccccctcccatattgtggggacttccaggcactccccaagagttaggtgaaattgagttacagcgacagctacaggctttaggaaaaattacacaatctcagcctgggtaaat

SEQ ID NO: 193695 - DNA, 1250 bp, Homo sapiens
  Payload ID: 18246
  Gene Name: transmembrane protein 161B
  ENST ID: ENST00000507872
  CDS Start-End: 97-558
gtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaattagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttgtaagtatgggcatttgagggctgatttttatcaccaaaactgctttactaaatgttatttactgtatttcgttttcagtgataaaatcaggacactgtatttttcagacattaataggaatgctaaaagatgtgttagaaaattgaaactacagaccatcatgtaacatttttgtgatctttattagttaatgttaatgattattaccttgcactaatattaccttacacactatttttttcctcctctttatgtccagtcgtcatcatttttctgt

SEQ ID NO: 193696 - DNA, 1892 bp, Homo sapiens
  Payload ID: 18247
  Gene Name: transmembrane protein 163
  Uniprot ID: Q8TC26
  ENST ID: ENST00000281924
  CDS Start-End: 66-935
gcacttctgactcgagtccccgccgcgcttgtcgtcgccgccgccgggatccgcagccccgcgccatggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctaagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggca

SEQ ID NO: 193697 - DNA, 5452 bp, Homo sapiens
  Payload ID: 18248
  Gene Name: transmembrane protein 164
  ENST ID: ENST00000288381
  CDS Start-End: 339-1115
aagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaa

SEQ ID NO: 193698 - DNA, 5566 bp, Homo sapiens
  Payload ID: 18248
  Gene Name: transmembrane protein 164
  Uniprot ID: Q5U3C3
  ENST ID: ENST00000372068
  CDS Start-End: 340-1233
gaagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatg

SEQ ID NO: 193699 - DNA, 5567 bp, Homo sapiens
  Payload ID: 18248
  Gene Name: transmembrane protein 164
  Uniprot ID: Q5U3C3
  ENST ID: ENST00000372073
  CDS Start-End: 337-1230
ggaggggcccgtcggcggcgaagttgctagctgggggcagagacggccacgcggttgcaggaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaa

SEQ ID NO: 193700 - DNA, 4975 bp, Homo sapiens
  Payload ID: 18248
  Gene Name: transmembrane protein 164
  Uniprot ID: Q5U3C3
  ENST ID: ENST00000372072
  CDS Start-End: 196-642
gcggctgctgcagggggaggaagacggggaggaggagccgtgcgccgcggcggcggccgccaggggaaccgagcgcccggcgcggagagcgcgggagcggagcagtagcccgatccggggccgcgggccgagctgccgatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatg

SEQ ID NO: 193701 - DNA, 1928 bp, Homo sapiens
  Payload ID: 18249
  Gene Name: transmembrane protein 165
  Uniprot ID: Q9HC07
  ENST ID: ENST00000381334
  CDS Start-End: 234-1208
gactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgacca

SEQ ID NO: 193702 - DNA, 1657 bp, Homo sapiens
  Payload ID: 18249
  Gene Name: transmembrane protein 165
  ENST ID: ENST00000508404
  CDS Start-End: 228-458
agtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagggacatcagtttttttcttggtagcaagctgtagattttgtttcaaggaaagcatcttcatcttctctagtttcatcatgtatagatggagattccgatgcagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttag

SEQ ID NO: 193703 - DNA, 828 bp, Homo sapiens
  Payload ID: 18249
  Gene Name: transmembrane protein 165
  ENST ID: ENST00000506198
  CDS Start-End: 234-623
gactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgg

SEQ ID NO: 193704 - DNA, 1567 bp, Homo sapiens
  Payload ID: 18249
  Gene Name: transmembrane protein 165
  ENST ID: ENST00000608091
  CDS Start-End: 1-476
ctgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaattttggagtaagttgttacacagctatagataactaatatactatacttctgacctgatataacaaaaaagaaaccagagttccaattctgactataatttcccagccagtgtctttagggaagatttttttttcccctcttgaaaccccaatttcagtattttcaaagtggggatattacctacccgataaaaatatctgatgtgtaaattatatttcataattcatataaataacctagccagagactagtacatcactgggaataaatggtagttttgagatcagacacatctctcatccaattttctttttagaggcaggtgagactctaaaatattaaattaaaaataagtagtaaagtataatcacatccccgttataagtgaggaaataaagtatttttgaaaaatagttttcctattaattattgagtttcatcttttattggggagaaattaaaaataattttttttaattataagaaacatactttgtcagcagctgtctcaggaagagactcttcaatgccaagttctcgtcgtctttcagccctaacttctgcataactacaaatggaaaaaataatcaaattttagtgtctggtcattcgtttaaaatactgcacagctgtaactattcagtgttgttacgtgtctcatctgttcatctagactatttgctatgtgctacacaaacctaaaatatacctataatgtcttaatttaacttgcatttttctaggtatcttaaagtttcatacactgctgtaaacgatccataaccacacaatacttaaattaagaaaaataaataaaggaagtgtatgcttatcta

SEQ ID NO: 193705 - DNA, 572 bp, Homo sapiens
  Payload ID: 18249
  Gene Name: transmembrane protein 165
  ENST ID: ENST00000506103
  CDS Start-End: 1-82
attaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattaca

SEQ ID NO: 193706 - DNA, 4630 bp, Homo sapiens
  Payload ID: 18250
  Gene Name: transmembrane protein 167A
  Uniprot ID: Q8TBQ9
  ENST ID: ENST00000502346
  CDS Start-End: 174-392
cttttccggtggagaggagcctatcctagtgtcttaaccgcccgtcttggtaggcggtgccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 193707 - DNA, 3730 bp, Homo sapiens
  Payload ID: 18251
  Gene Name: transmembrane protein 167B
  Uniprot ID: Q9NRX6
  ENST ID: ENST00000338272
  CDS Start-End: 1071-1295
cgacgacgtggtgctttaggatctgaaagatgcgacttggtttttgttgttgttgttgttgttgttgttgtttttgagacggagtttccgctcttgttgcccaggctggagtgcaatggcgcgatctcggctcaccgcaacctccgcctcccaggttcaagcgattctcctgcctcggcctcccgagtagctgggattacattacaggcatgagccaccatgcccggctaattttgtatttgtagtagagacggggtttctccatgttggtcaggctggtctcgaactacgatctcaggtgatccgcctgcctcggcctcctaaagtgcttagattacaggcatgagccaccgcgcccggctaattttgtatgtttagtagagacggggtttctccttgttggtcaggctggtctcgaactccgacctcaggtgatccgcctggctcggcctcccaaagtgctgggattacaggcgtgaaccaccgcgcccggccgcgacttgtttttgttacaaggttcctcatttcatttgcaacgttcagacgcagtctgactagatttccatccggagtaaggaagagcagctcaagggcagtcacggaggccgcaggtgcggcttcttcacccgcggtgctggagttctctcaagtggaagcccaggacgatgaaaacctcataggtaggctgctgcttacacacagcagccgccacggcgcaaaataaactacaaaactacaagcctttaccttttcaaacacactgacgcgggccagccccagccctacgcccgcaggggcacgcagaaaagacttagttaccacggccaagtacgaagccttcgagatagcgttcttcttaccctacgtaaacacgcagtttcccgagctcgacaatcggctagccactcctgatagcgttcggcgctcgcctctcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaca

SEQ ID NO: 193708 - DNA, 7470 bp, Homo sapiens
  Payload ID: 18252
  Gene Name: transmembrane protein 168
  Uniprot ID: Q9H0V1
  ENST ID: ENST00000312814
  CDS Start-End: 562-2655
gttctcagctgctgattccaggtcccaggagtcgactttggcttgaggaaggcaggcgccttaggtggggcagttgacactcgcgcagcgccttgctcacctgagtgtgtggcggcgcgcgggtttgggcggggagggggccgggcctcgggaaggaggcgcgccgcgcagtttgaccccggcggcgttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgttaaaattatgagcttttagcttaaaaaaagttaatgttaagtaaaatctccttttaaatttctcagctatttgtgagcaggttagctttaaagcattatctcttcactttaagaaagccaaatacaaaagtatattctgcattctttataaggtagtattaaggtggtactaaaaattacattttaaaaacagctgacagtttgacagccacaaacctaactttttcatatgtatttcctgtgaaagtaaaaccaaaaatggtctttgggccaagaatgtgacttgagccaatttgttaaccaaaaatttatagaatgtccactttgatgaattctcctacccaaacaaacaaaaaacaataaatgactttttgggatggtatcacaaagctaacattttaaaaacaataactaggccgggtgcagtggctcacgcctgtaatcccagcactttgggaggcctaggtgggtggatcacttgaggccaggagtttgagaccagcctggccaacatggggaaacctcatcgctactaaaaatacaaaaaaaattattagccgggcatggtggcaggtgcctgtaatcccagctacttgggaggctaaggcacaagaatcgcttgaacccgggaggcagaggttgcagtgagctgagattgtgccactgcactccagcctgggcgacagagcaggactctttctttgtctcaaaaaaaaaaaaaagtacatgtttagccaggcatggtggctcatgcctgtaatcccagcactttgggaggccgaggcaggtggatcaaaaggtcaagagatggagaccatctggccaacatggtgaaaccccatctctactaaaaataaaaaaatcagctgggcgtggtggtgcacgcctgtagtcccatctacttgggagactgaggcaggagaatctcttgaaccggggaggcagaggttgcagtgagccgagattgcgccactgcactccagcctggcaacagagagagactccatctcaaaaaaaaaaagaaacaaacaaaaaaaataataagggtgtagaaaagaaatattacaagaagaataaagtgattggttactttcacctaaagattgaaaaatagatctgacaatgagactaatttgtctatggctgtcatgtttaagaaagagttgcttggagtgaaaggaattattttagggcaaaactttaccattctactaaaaagaggtaacatggagattttttcaacataactttgtttagtatttgtttcctcatgtgataccttgctaaaaccacaaaaccactagctctaaaaacatcatcttttttttcaatagaataaaaaaaacagtatgaatttattttctttttttaaccattatttatttattttaattttattattattatactttaagttttagggtacatgtgcaaatagcatacacactgttgcaaaataaataaggagccaagttctttctctccccatgacttttcagttatgccatcattttattcaaaaatttttagtttgctctgatctaaactcttccctgggaaacttggggttatatttccatagaattctgtcttgctcttaataaattcaaaattctttggaaaagatgcatttcagaggattattcttatgaccagttatgctttaaaaaaattaaagtcttaattaaaatgcacttatatttaatgcattagtgggtagatttttgttttgagtaaaatctttattagaatctatttgtaactggatattttgtaattttgggctcaaacatatttactcttgggtactgcttttttatatgtattcaaatttatagcttagtctcttttaaagtaatattctacattactttcccacaagtgatgatagttaatataatgtatgccagaagaaaatgatttaattttaagaatgtgattagatatatttgacagtaagtgctcaaaggagttagatctgtcagtactttcgaatgtctcctgtattggaaactattagactgtcacctctttttaggcagaggcttacacatgttggtatttctggtacacagttaccgagaagagtgccttgtccgtaatgagaagcatttaataaatattttggactgagtgaataaatctagaatcctaaggagaaattggaataacttgattgtaaattactacattttctttagttttacttaaatggatattatttcaagatcttcattaagcaagtaatttagtaaaaaacttacagaatccataaaaagaaagcaaatctcaaatttgtagttaagagtaataagtgttaagattagggaaggaaaaactgtttcagaactggtttgaatgaaaacatagctgatgttgccaaaaaatggctttttgtgagttgagtccatttccatcatgactctaatatcattaagattgaatcattcatttcctcactattatatctagacagattggaaatttaccagaaatggaaattattaaaagtctgactgatgaacaaagaaggaatttgactatgcatatcagtgacaactaaattggaaggtcagtaaaataggcctataagcataagcaggttaaggacaagctagggaaactataagtatctccttttttatattgtcttacctattcactaattataacacatagaaacaatataaaacgatgaagtttaagcagtaattgttttgagaaaccattctgttgataatttacatttatgtttattaggaaatattgttattattacttagaccaaagttgactgaaaattgaaaactgtgggctacccgtaaggttttttgctttgaaatattcaatacctaaaagccattttgattttaaaaatgaagttgaccagtcatcttgtatgatgacctcataatattttataagtttgaacttaaaatagttagaagtagacagttttagtaagcttttgtttttatttggtctagcctaaaagacattgatttatctcaaagatttttagcagtgtgcaagggacaaatgagtatgacatagcttcctagacaagcagtgttcactcaatgccaagtaaacttttctaagttcaaaaatatttttatattaaaacacataccaatgtattgatgaa

SEQ ID NO: 193709 - DNA, 2659 bp, Homo sapiens
  Payload ID: 18252
  Gene Name: transmembrane protein 168
  Uniprot ID: Q9H0V1
  ENST ID: ENST00000454074
  CDS Start-End: 454-2547
gcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcaggctgtcttttgaagaagatcagaatggggaagagttttgtaaattagccatttaaaaacaatctgccatgttgattttggtccataggaagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgta

SEQ ID NO: 193710 - DNA, 799 bp, Homo sapiens
  Payload ID: 18252
  Gene Name: transmembrane protein 168
  ENST ID: ENST00000418785
  CDS Start-End: 1-777
ttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatat

SEQ ID NO: 193711 - DNA, 775 bp, Homo sapiens
  Payload ID: 18252
  Gene Name: transmembrane protein 168
  ENST ID: ENST00000449743
  CDS Start-End: 403-775
cggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggta

SEQ ID NO: 193712 - DNA, 1291 bp, Homo sapiens
  Payload ID: 18252
  Gene Name: transmembrane protein 168
  Uniprot ID: Q9H0V1
  ENST ID: ENST00000447395
  CDS Start-End: 289-1230
agtttgaccccggcggcgttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgcca

SEQ ID NO: 193713 - DNA, 570 bp, Homo sapiens
  Payload ID: 18252
  Gene Name: transmembrane protein 168
  ENST ID: ENST00000441474
  CDS Start-End: 234-570
gatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattg

SEQ ID NO: 193714 - DNA, 3342 bp, Homo sapiens
  Payload ID: 18253
  Gene Name: transmembrane protein 169
  Uniprot ID: Q96HH4
  ENST ID: ENST00000295658
  CDS Start-End: 208-1101
ggcaaagccgcatcctcccggagcagaaccgctccccgccggctgtccgcaacctccgccagcgtcggtccctgggcaggtgtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctcttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgattaacttttgctca

SEQ ID NO: 193715 - DNA, 3174 bp, Homo sapiens
  Payload ID: 18253
  Gene Name: transmembrane protein 169
  Uniprot ID: Q96HH4
  ENST ID: ENST00000406027
  CDS Start-End: 441-1334
agaaccgctccccgccggctgtccgcaacctccgccagcgtcggtccctgggcaggtgtgggtgagactgctcgttcgtttctttaaatttcgatgccattggggagggtggaagggaaatgcaaaaaaaaaaaaagaagaagaaagaaacaagcagggtgtgctctatttcaaaaattcaatcctcagggctgaagctctcacgattaattaaaattaaatctccagtgcagctggaaaaagaaaggctgctgctcggcgccctcgctgcgcccgcctgccggggtcggacgtcggcgatgctgtggctccaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaa

SEQ ID NO: 193716 - DNA, 584 bp, Homo sapiens
  Payload ID: 18253
  Gene Name: transmembrane protein 169
  ENST ID: ENST00000433112
  CDS Start-End: 235-584
ggcccggccccgccccgcccgccggccgcggcaaagccgcatcctcccggagcagaaccgctccccgccggctgtccgcaacctccgccagcgtcggtccctgggcaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagat

SEQ ID NO: 193717 - DNA, 1634 bp, Homo sapiens
  Payload ID: 18253
  Gene Name: transmembrane protein 169
  Uniprot ID: Q96HH4
  ENST ID: ENST00000437356
  CDS Start-End: 218-1111
ggccgcggcaaagccgcatcctcccggagcagaaccgctccccgccggctgtccgcaacctccgccagcgtcggtccctgggcaggtgtgggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaa

SEQ ID NO: 193718 - DNA, 3460 bp, Homo sapiens
  Payload ID: 18253
  Gene Name: transmembrane protein 169
  Uniprot ID: Q96HH4
  ENST ID: ENST00000454545
  CDS Start-End: 327-1220
ggcccggccccgccccgcccgccggccgcggcaaagccgcatcctcccggagcagaaccgctccccgccggctgtccgcaacctccgccagcgtcggtccctgggcaggtgtggtgcagctggaaaaagaaaggctgctgctcggcgccctcgctgcgcccgcctgccggggtcggacgtcggcgatgctgtggctccaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctcttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgattaacttttgctc

SEQ ID NO: 193719 - DNA, 578 bp, Homo sapiens
  Payload ID: 18253
  Gene Name: transmembrane protein 169
  ENST ID: ENST00000455479
  CDS Start-End: 274-578
agaaccgctccccgccggctgtccgcaacctccgccagcgtcggtccctgggcaggtgtggtgcagctggaaaaagaaaggctgctgctcggcgccctcgctgcgcccgcctgccggggtcggacgtcggcgatgctgtggctccaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgt

SEQ ID NO: 193720 - DNA, 1797 bp, Homo sapiens
  Payload ID: 18254
  Gene Name: transmembrane protein 17
  Uniprot ID: Q86X19
  ENST ID: ENST00000335390
  CDS Start-End: 213-809
gcgcggctccctgggcctggaacgcgctctgagcgcgccggtcccttccaggttgcgcgggctccggacgagacccagcccagccgggcagccccgcgcgctcccgggtcccgccggcctcgcgccgcccggttgccgtgggaaccacggagcctcggagcgcccgcagactagcccgtgtctgagggggtgagggatactgaggcccaggcatggagctgccggatccggtgcgccagcggctgggaaacttcagccgggccgtgttcagtgattccaatcggaccggtccagagtccaatgagggtccggaaaatgaaatggtctccagtttggcactgcagatgtcactttattttaatacctactatttcccactgtggtgggtgagcagcattatgatgcttcacatgaagtattcaatcttacctgactactacaaattcattgtgatcactgttatcatcctaataaccttaattgaagccatccggttgtatctgggctacgtgggtaacctacaggagaaggttcctgagttggctggcttttggcttttgagccttctattgcagttacctttaattcttttcttgctctttaatgaaggcctaacaaatctgcccttggaaaaagcgatacatatcatcttcactctcttccttgctttccaagttgttgcagcatttcttaccttaaggaaaatggttaatcagttggcagttcgtttccacctccaagactttgaccggctctctgcaaacagaggagacatgagaaggatgaggtcatgtatagaagagatctgatccagtgttgttgagtgaaaatctgacagatcattctagagactgtaagagttaggaaaatatcagagctctgagaaaagggacaaagcaagtgttttgaattgtatatgctctcactctgaaattccaaggttgggggcaatgatgaaactttgtacagtatatgaaacagtatattaaccctaaaacctagatgttgtccacctgatgccaaatttcttaattttttttgatgttgttgtctttttcaggagtgtagaaatctatgtattggtggttgtcatttgccagctctctcgtagcatttctggttagaatctttaactagagatgtatacatttctttaaaacttgttggttatccatgtcttgtctgtacatatgaccatgtttcttgacatggaaataccagtcagtgttcctatgtatttgtctatatttgtaaaccaagagaccggctgggtgtggtggctcacgcctgtaatcccagcactttgggaggccgaggtgggcagatcatgaggtcagaagatcgagaccatcctggctaacacggtgaaacccagcctctactaaaaatacaaaaaaaaaaaaaattagctaggcgtggttgcaggcacctgtagtcccagctacttgggaggctgaggcaggagaatggtgtgaacccaggaggcagagcttgcagtgagccgagatcaagccactgtactccatcctgggtgacagagcaagactccatctcaaaaaaataaataaataaaaaataaaacaagagaccaaattttcatgtctgctagggttaaattctaaccctaatattagctgttatactgagatgaagaagaaaacaggtggattgccttggtatttaggaaatatttttgttataaaattacaactttcataaaaccatattcagtatttgtaatggtggtatacaaaatgcttttacaataaattattaaatatttaaggtatcagcagc

SEQ ID NO: 193721 - DNA, 4959 bp, Homo sapiens
  Payload ID: 18255
  Gene Name: transmembrane protein 170A
  Uniprot ID: Q8WVE7
  ENST ID: ENST00000357613
  CDS Start-End: 90-455
gacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgacttttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtagagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacacctataatcccagcactttgggaggtcgatgtgggaggattgcttgagcccaagagttcaagactggcctgggcaacatagtgagaccttgtctctactacaaaataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattttaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcatgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgtgaa

SEQ ID NO: 193722 - DNA, 1072 bp, Homo sapiens
  Payload ID: 18255
  Gene Name: transmembrane protein 170A
  Uniprot ID: Q8WVE7
  ENST ID: ENST00000561878
  CDS Start-End: 99-533
gctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaa

SEQ ID NO: 193723 - DNA, 4345 bp, Homo sapiens
  Payload ID: 18255
  Gene Name: transmembrane protein 170A
  Uniprot ID: Q8WVE7
  ENST ID: ENST00000568559
  CDS Start-End: 90-455
gacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgacttttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtagagataggtttcaccatcttgcccagcactttgggaggtcgatgtgggaggattgcttgagcccaagagttcaagactggcctgggcaacatagtgagaccttgtctctactacaaaataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattttaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcatgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactt

SEQ ID NO: 193724 - DNA, 2331 bp, Homo sapiens
  Payload ID: 18255
  Gene Name: transmembrane protein 170A
  ENST ID: ENST00000569540
  CDS Start-End: 167-487
gtgctgtgggcgccccgagtctgggcggggtcccgggtgcgcagcctgctggcggcgtgggcgctgtcctccgggaggggggccgtgctgctcgcccggagcccctttccccatcacttcttcggcggtccctgaggcggagccccggagtcccgctgggcgtgagatgcagagagcggccgcagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgacttttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtagagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttgg

SEQ ID NO: 193725 - DNA, 609 bp, Homo sapiens
  Payload ID: 18255
  Gene Name: transmembrane protein 170A
  ENST ID: ENST00000569276
  CDS Start-End: 73-414
ggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtatgttagacattaaaataccagtcaaaaatgtttaatatgactagtcaatttcaggacctattctagaaaacatatctgagtaggatgaaggaaagagtgccttttaactgcaagtccagacagggtctccctatgtcaccaaggccggagtgcagtggttgcaatattggctcactgcagcctccacctcttgggctcaagtaatcctcctccatcagcctcccaagaag

SEQ ID NO: 193726 - DNA, 547 bp, Homo sapiens
  Payload ID: 18255
  Gene Name: transmembrane protein 170A
  ENST ID: ENST00000566980
  CDS Start-End: 69-299
acttggcagcgccgttgggattgggggaagaggaccccggctggaggtgacgctgaggcggcgaggagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaag

SEQ ID NO: 193727 - DNA, 734 bp, Homo sapiens
  Payload ID: 18255
  Gene Name: transmembrane protein 170A
  ENST ID: ENST00000567796
  CDS Start-End: 79-378
acaggctttctgaagggaggaggccaagttgggcggattgtttgagccgaggcattcaagaccagcctgggcaacacgatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaa

SEQ ID NO: 193728 - DNA, 8362 bp, Homo sapiens
  Payload ID: 18256
  Gene Name: transmembrane protein 170B
  Uniprot ID: Q5T4T1
  ENST ID: ENST00000379426
  CDS Start-End: 1-399
atgaaggcggaggggggcgaccactccatgatcaacctgtcggtgcagcaggtcctgagcctctgggcccacgggacggtgctgaggaacctcacggagatgtggtactggatcttcctctgggctctcttctcttctctgtttgtccatggtgctgcaggagtgttgatgtttgtgatgctgcagaggcataggcagggaagagtcatctctgtcattgcagtcagcattggatttctggcttctgtaactggagcgatgattaccagtgcagcagtagcgggcatttacagagtagctgggaagaacatggcccctttggaagcgctggtatggggcgttggacagactgtactgacattaatcatctccttttcaaggatcctcgctacactttgaggtttctgtgggaatgtcttacttcacataaggaaacagatgtacagattccctgaaaacggcattgttaacaagtggaaatgaaattgtgcaagaatgtggactgagcaggtcaaagcataaggaagaccttgagctgtgtggaaggattgccctctggtgttcaagtgattgcactaccgcactgcaccttatgtgcctctgtctcaggcaaggtgcattaagacactatgtaaagttacaagaaaaagcaccttgtttagctgcctatcaggttaacattggtgttgaaatcatcgttcctaacagtgttatgttaagttacagggacgttttgaggtattgatatatgtgccaaactcttttctttttgttaacattgatcatgtgacaatttgcaagtgtagatgtagctgagtgctgtgaacatatttgacatgaattcaggtaatgtactaagatttttgttcggtaacactaaatcccgtatgagtgctaaatactgaattgtttaatatgagagaaattatttggtttttaatgttgcgcgtttctgggatttagggcttcaatatgtttaggtattattgttatttaattgatgtggaagataagtcttcttaactgaagactagctcaactgttttaagaactcagagtagctctatagggtgcatacttttcaccaacttaagtaacacccttttaatagcttctctcatgcatccatattctgtttatacaaattcagaaacttgaagggtcatacacattgattgtagtttgtgcgtcataaaaatgtaatttgaagattttcttaaaaatttttgtaagaaaaaagtctgaaatgcatgttgcattctttgacccttctaaagaaagtttttgccttgtatctcatggacaaaacatctttataactagtatctcagtgggattgtattacgtgttgcatatatcttgatttttgacaaaacataaacagtctttcattctggagtattaactgtttttagagactggcctaaattaggctctggaaataaagacctcatttgtagaaataagtaacaagtaagttatataggaagagtaatgaactattttactttggacatgtggcaacatcataattttgctaagtaaaaattggggaatatagtagataattttaaaatttggcaattagtctcagcatatcaatgcagtactgagcgtgtattagagtaattcagttgttcagttcttgatttatgatatgaagttatgatttaagtttagtagaagaatctgtgagggcatatagcaaaagtggaaatgtcctttatataaaacattttaagaggttctggcaatacgtaattgtaagagtataggaagtagggttgaactggtctcctaatgagattttttttggcaccagatacaattataatgtgctaactcaaaggagacattgcagagaatatgaagttaaggataatccaaaaataacctggtagccttgctgtttaatccaatttgctataaaagtaggcctttgttatattacattcaaatttaagaactttgttacccataccactttttctctatccagaagcagagtatatccacaacttaccaatgagaagttggagaggcagtacttttctcagtatggaagccaatttgggagatttactaacactggcttggaaatttgttttaaaaaaataataagcaactatgcatggatctttgaagtaaatcttaaaattgattatttttattatgtacaggcctgaaattgttttcatgtgttctttatattcctgatgtttttacaaattaaatttaggcataacttttccaagtcaatctgattttttcttttctgccagacttgaattgtgttcttcttttactttggctattctgtcaataatttaaagcattcgtattcttccagaggaattaccaatagcatgtggaaattgtttcagatctccagaatgaatacttattttaacatatgtttattttatgatttaagaaagttatggtaaagtaatatggagcatgattcataatccaaaattaacaagaaaataacttggatacattaaatgtactaatgtgtggaccaaagagatttaaactattgtttttactctagaatgaaagtataattgaacggttaataattagtttgtagagtgtcctgcagttattatcaagttgctttacattatcaattgtgtgtgtatgtgtatacttttaattttaggggttatttttggtttctttgctgttttcagttatttccattgagattttgtgcaactgtctctcttttgatgttttgagatgcagttgaatagtttgagtttgtgaattgtcttaatagctatttatatgctgaaatttttaaaaagttagtagctttcctatagacacaagaaatgtttaatgatatatatacacacacgtatatatcattatataggtatatagagagctgctatatatgaatacagtctacttggaaagctttttttcagtgaacactttcatgttctagtggaaaatttgttcagtgtaatgatcttttaaataggtttgaggatgtttgaaaattttgaattttgggaaaattttcttcacttaatagagctggagacccttgtttgggacatgacaaaagtccttattgatgtatttgggttatatactttgttaaaattcgtatgtgatttagcagtacattttcttcgtgacaaatgcaagaagggagggaggatcctctatagtggacactcctttatttaaaaaatgtttaataaaatattgtttatagtgaaatcagctccccaaagaaggaactcctacatgcccaaactaattacagttgaacatactgattaaaaatgccatagatcacagctagtcaggaggcctcaaataaactgcaaataatgcttaaaactttaaaagaaggagaaccagcagtcttccgaaccatgggacagttccaaggtaatagcctaccttgcctaggataagtgaagtcctaaatgatggctatcttcagggcctggagcagaattattctttagatcttaatgtttaccaaacagtgttacagtttgttacccaatatactttcttagtatttgcagcatacatttcactgctcaaaaaagtataagggttttgtttgtactttaaatgagagaaataaagaaatgagttggcctgtatatcttgtatttgtgatatgagcaacgggataatttgaaatcacagaatgttgtgggaaaggtctttaaagaacctctaatgaagaaaatgtggctgccacattgatgtacctaggctgccactcatacagcaaataattctattttgtaaacacttcgtgtggatccactatgtaaagtgctctaccaagtattttctctagtaagaagtacaagaattaccaagatggaattctttaccttgagtacaccaagagctagcaagatgatttttaaatcctaaaaagtttgggacaacattttgcttcctgattttagttgagagttagcctgttatccctccaaattctcattttcctggttcatccactaaatagaatttccataactgagatatcatggctgtgacatagtgaagagaatacgagactccaagccagcaacacagattgaattaagactctgtcacttgtcaactttttgaccttgagcaaatcacttaacttctctgagcctcagttcatactccgtaaaatgtgactaatacctcatgtagttattgtgaggattacgtgagattgtttatgaatggcaaagcagtatgtatttcacagtaaatgatcaactgatagtctctagaatttttttaaattacattttgcaattgcattaccaattgaatatgttgttttgtaaaattcatcaattttgtttcatttctatattttccttacatatgctttaggaaagaaactaaaaacgttttcttataatcttgcttcatctccttttcactttttctttttaaaatcagcagatctttaagaaccttttgtgaattggtggtggtggaaatggccagtgcaagcaggattaaattaggagttctgttgaccactggttaaaataggaaaagggtagagaggtagtcagccttgactcccttatctattcccacttacttcccttggattcattcagccatgttgatttattgactttctgctatttgctaattattcttcttgaaaagtaagagcgatatataacccttcagtcttctatatgtctgtttcttctgccggccctgggcccttggctctacagtgtagtgccaattctgtagaaaaatagaacgatattcagtgtctaccaagttctttcttccacaggccaagggtgcttaagccctagctgttattttgtttcttttatttatttattttttgagacggagtttcgctcttgttgcccaggctgcagtgcaatggcatgatctcagctcaccgcaacctctgcctcccaggttcaagcgattctccttcctcagcctcccgagtagctgggattacaggcgtgcaccaccatgcctggccagttttgtatttttagtagagacagatttctctatgttggtcaggctggtctcaaactcccgacctcaagggatccacccaccttggcctcccaaagtgctgggattacaggtgtaagctgccgtgcccagcctatttttttttaacttcaaatactattattttaaatttatgttcattatgtaattcagggagtaacgatgcctggagcaatttctgaaatattctcaaaccacttcactcttgacactacagatttttctctcagtctcaatcagaatctctgcagtcattatttgtttttaagatgtgagggacgaggaaaattactgaagaaattctagcagatttcgattgcagagaaatttggtaacactttttgggtaactgggtaaattactatttcttttaataatcgggtgaaactctgaattgttaaaacggaccaataatcaaatggttttataatctttcttaacttcccgtccttgttataacatcttggaagaagactcttcaggataaaaaggatattatttgattaaaaattatagcatttggagaggtaacacacaaaaacaaaaacatatttgacaaagcgccctacatcctgtgttttgttaggactagaaactatactggatgagtatgtatactgcatgtttacacatgctgtgtttctttatatgtgaggcttcactgaccaccgtgcattttgaaattgtattgcattttgtgtgtgtgtgtggtgacaggtttgctcttctcacttaaggagctctggtctgtgtaggcagtacagtgttgttagggaggttgctgaattatctaaaaatgtatccatgaatttgggggaaataatgcttaatatctgaagtattttcagtaaatgtggagatatatcagataatacttttaaattagtggaaacacatttctgagtgaactgagctatgaactataatcatctcttcccctgagtttagggaagttgttttcacattctttacatttattgcacatatactgaacttacataataactcttccctgattttgagaacgaatttagcaatttcctaaaaatcttcctcctctttccatacagatgtcgtatgttatagtttaaacatatgtacaatttgttgatagaatccaaggagctggtttaggaaagaatactcttaacccctacagttatgcagctctaatcttactgaaaagtaaatactttaggcaagtcaggagagcatgaacctcatacatacatttttacgattatgtactgcacccacatgtatctactcttggtagtaacatgactccaccctttttgggaatgtatttaggtggataactgaaacggaaaagcagtttgacacaaatacacagaaagaggaattgcggtgcataatcaatcgtctgagtcccataactgtaacactttttctcttataaattggtagttcctaaaaatcaccactttaaaaattttattctgtcttgctgaattaagcagaaatcactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgcttttaatagcagatgagttgatagtttaactgttgacactttcttaatgtttttgatgttggatgcatttacaatggaagaatttttttgaaagatttggccctctcaccaatacacacattcagacttgagctgcacgcatttagatgaacaaataggaaattcacggtattttttgttttagccatccaaaattcataggattctaccaaaaatattagcccctgactctagttattctgagatgagggaatcaactttatcttgaaagttaactagctaaaatgtctttatttaaatagcaaaaatatagtttacctgacaagtattaaaagtctcactttcaaattgtgttaactctcagaccactgatgaatcttttggtaaatcacaggcagattttaaaagctaaatgaagccttagtgccttgaaagttaagatacttgtgcaaaatggatttagcaagattcaggattggcaccagtgagttggctagatacacatcaccagtgactgggaattcaaagtttagaaagcctaacgaatagtagctactaacttcatatggttcaatgtaaatcagttacttagtcattgactgtgacagatgacagctactttcactatattttcatgatgtggtatttttctctattttttctttttccaagtatgaaatggaaaaaaatgtagttaagaaaattaagtgtgagactttaaaatttagttttgttgtaaactagagattctagtgaacagtgttagttttatactgtagtacagggcacacactttaacctttagaaatatgtttaccatcagggatttatttttactatagaaatactaaatgtactgtgaagcttaaagacaggagaataaatgttggaggggtaatacacaaaaacaaaggcatatttgatgaagtaccctgtgttatgtgaacacaatttccccttctgttaagactataaactatatgagtatgtgtactgcatgtttacataaaacagtttaattttgaaggattattttaaaaactatgtttatatataatacctaacaagctgtaaatattgtatattattgatttttaattttatataagcaattttttatttcccaattcatgtacaaatctcattatgtatatagcataatttcctggagaacacaaattttgcagtgaattttaagtaattttaattgcagtaagcatcagtttagcctagagatgttgatctttattttaaattatttttcaccattctcattttcttcaaagggcagcaataaacatatgcaagttatttttaattatagaaagtaggtctacaaagataagatctaggttccaattcattgctttaaggaaaagatgcacaattactatcattcagtgtctaatcacaggaccatttctgaggtccacatgtggctctcctctttgtaatatacagggtgaactctttactgatacacacaagacaactgttaaaaagtgaatccagcacttaaatgtcattacacagaatttattggattaaaaatttgtaatatacagtattttaataaagtttctgtattcaatttcatgcacttatatataaataaacctgtctttgaaagcttta

SEQ ID NO: 193729 - DNA, 1247 bp, Homo sapiens
  Payload ID: 18257
  Gene Name: transmembrane protein 171
  Uniprot ID: Q8WVE6
  ENST ID: ENST00000287773
  CDS Start-End: 197-1168
cgcaccaggacgcgcggtgggtagggtgcagggcggccggcgcagccgaggccgcgtgcggaggcggacgccgcgcccagccagtgcccacagcagcgcggtcagccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagca

SEQ ID NO: 193730 - DNA, 1535 bp, Homo sapiens
  Payload ID: 18257
  Gene Name: transmembrane protein 171
  Uniprot ID: Q8WVE6
  ENST ID: ENST00000454765
  CDS Start-End: 474-1448
gccggccccgccaggtgtgcgggccaggcagccgtggaaggtgcccatttctcccagattcctcgcgcgcacggccacgagcgcggaggctgccaaacccgccagccctgggttccgaagccgcccctggctctccattccctcgcgggcgcgccccgggcccccagtggcggccagctcccaccggtcgctcctgcactgccctgccctgccctccccgggccgccgcgcccgcgcagcaccgcctccttctctaaatactgccgggtccgccctccgcaccaggacgcgcggtgggtagggtgcagggcggccggcgcagccgaggccgcgtgcggaggcggacgccgcgcccagccagtgcccacagcagcgcggtcagccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatggcaggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcattggctat

SEQ ID NO: 193731 - DNA, 1771 bp, Homo sapiens
  Payload ID: 18258
  Gene Name: transmembrane protein 173
  Uniprot ID: Q86WV6
  ENST ID: ENST00000330794
  CDS Start-End: 335-1474
tataaaaatagctcttgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccatgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgta

SEQ ID NO: 193732 - DNA, 901 bp, Homo sapiens
  Payload ID: 18258
  Gene Name: transmembrane protein 173
  ENST ID: ENST00000510817
  CDS Start-End: 143-901
ggctagagtgttgtggagaaaccaatcgttgttaacatctcattttcaggctgcactcagagaagctgcccttggctgctcgtagcgccgggccttctctcctcgtcatcatccagagcagccagtgtccgggaggcagaagatgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccatgctggcatcaaggatcgggtttacagcaacagcatctatgagcttctggagaacgggcagcgg

SEQ ID NO: 193733 - DNA, 1759 bp, Homo sapiens
  Payload ID: 18259
  Gene Name: transmembrane protein 174
  Uniprot ID: Q8WUU8
  ENST ID: ENST00000296776
  CDS Start-End: 50-781
tctcacaatcctctccactctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggtgagcccctgcggcctcataacctctggaggggcagcagccgccatgtcaagtcctcctcaatactacaccatctaccctcaagataactctgcatttgtggttgatgagggctgcctttctttcacggacggtggaaatcacaggcccaatcctgatgttgaccagctagaagagacacagctggaagaggaggcctgtgcctgcttctctcctcccccttatgaagaaatatactctctccctcgctagaggctattctgatataataacacaatgctcagctcagggagcaagtgtttccgtcattgttacctgacaaccgtggtgttctatgttgtaaccttcagaagttacagcagcgcccaggcagcctgacagagatcattcaaggggggaaaggggaagtgggaggtgcaatttctcagattggtaaaaattaggctgggctggggaaattctcctccggaacagtttcaaattccctcgggtaagaaatctcctgtataaggttcaggagcaggaatttcactttttcatccaccaccctcccccttctctgtaggaaggcattggtggctcaattttaaccccagcagccaatggaaaaatcacgacttctgagactttgggagtttccacagaggtgagagtcgggtgggaaggaagcagggaagagaaagcaggcccagctggagatttcctggtggctgtccttggccccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaa

SEQ ID NO: 193734 - DNA, 1860 bp, Homo sapiens
  Payload ID: 18260
  Gene Name: transmembrane protein 175
  Uniprot ID: Q9BSA9
  ENST ID: ENST00000264771
  CDS Start-End: 186-1700
acttcctggctgcgcgcgcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaa

SEQ ID NO: 193735 - DNA, 621 bp, Homo sapiens
  Payload ID: 18260
  Gene Name: transmembrane protein 175
  ENST ID: ENST00000509508
  CDS Start-End: 136-621
gaacttccggctgtcaagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactc

SEQ ID NO: 193736 - DNA, 1399 bp, Homo sapiens
  Payload ID: 18260
  Gene Name: transmembrane protein 175
  ENST ID: ENST00000508204
  CDS Start-End: 118-1386
ctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcc

SEQ ID NO: 193737 - DNA, 776 bp, Homo sapiens
  Payload ID: 18260
  Gene Name: transmembrane protein 175
  ENST ID: ENST00000504744
  CDS Start-End: 127-345
gccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgcca

SEQ ID NO: 193738 - DNA, 1006 bp, Homo sapiens
  Payload ID: 18260
  Gene Name: transmembrane protein 175
  ENST ID: ENST00000510493
  CDS Start-End: 155-1006
cccggccgggctgactcaagcggaggcgcgcggaacagtcgccgaggcgattcccgcccagatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcc

SEQ ID NO: 193739 - DNA, 525 bp, Homo sapiens
  Payload ID: 18260
  Gene Name: transmembrane protein 175
  ENST ID: ENST00000507319
  CDS Start-End: 186-525
acttcctggctgcgcgcgcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctgg

SEQ ID NO: 193740 - DNA, 683 bp, Homo sapiens
  Payload ID: 18260
  Gene Name: transmembrane protein 175
  ENST ID: ENST00000514453
  CDS Start-End: 147-683
gacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggc

SEQ ID NO: 193741 - DNA, 619 bp, Homo sapiens
  Payload ID: 18260
  Gene Name: transmembrane protein 175
  ENST ID: ENST00000514546
  CDS Start-End: 219-619
cggccgggctgactcaagcggaggcgcgcggaacagtcgccgaggcgattcccgcccagctcccctgccctgagacagcctccggtgcttctgctgtgtcccaggaaacaagcctgaagcaagcactcaccatccctcaagaatgtgccctgacctaccttcctcaccacggtggcatcagggccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccc

SEQ ID NO: 193742 - DNA, 784 bp, Homo sapiens
  Payload ID: 18260
  Gene Name: transmembrane protein 175
  ENST ID: ENST00000515492
  CDS Start-End: 149-784
tcgccgggcttgcgatgaacttccggctgtcaagctcccggccgggctgactcaagcggaggcgcgcggaacagtcgccgaggcgattcccgcccagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagagg

SEQ ID NO: 193743 - DNA, 1514 bp, Homo sapiens
  Payload ID: 18260
  Gene Name: transmembrane protein 175
  Uniprot ID: Q9BSA9
  ENST ID: ENST00000515740
  CDS Start-End: 269-1435
tccggctgtcaagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagt

SEQ ID NO: 193744 - DNA, 2084 bp, Homo sapiens
  Payload ID: 18260
  Gene Name: transmembrane protein 175
  ENST ID: ENST00000513952
  CDS Start-End: 169-387
gcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaa

SEQ ID NO: 193745 - DNA, 581 bp, Homo sapiens
  Payload ID: 18260
  Gene Name: transmembrane protein 175
  ENST ID: ENST00000513682
  CDS Start-End: 111-344
acttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttc

SEQ ID NO: 193746 - DNA, 1967 bp, Homo sapiens
  Payload ID: 18260
  Gene Name: transmembrane protein 175
  Uniprot ID: Q9BSA9
  ENST ID: ENST00000622959
  CDS Start-End: 645-1811
gtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcct

SEQ ID NO: 193747 - DNA, 1261 bp, Homo sapiens
  Payload ID: 18261
  Gene Name: transmembrane protein 176A
  Uniprot ID: Q96HP8
  ENST ID: ENST00000004103
  CDS Start-End: 302-1009
gcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagg

SEQ ID NO: 193748 - DNA, 1530 bp, Homo sapiens
  Payload ID: 18261
  Gene Name: transmembrane protein 176A
  Uniprot ID: Q96HP8
  ENST ID: ENST00000484928
  CDS Start-End: 582-1289
ggccccgcccaggctgcgcggtttcccgaaaccagctgcggcccgggggcccggcaaagggggttccgcccggaggagcggaccgggcgggagaagaccgagcccccgcgcgccccctgcgctcccactcgcgcacacttgcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgtta

SEQ ID NO: 193749 - DNA, 827 bp, Homo sapiens
  Payload ID: 18261
  Gene Name: transmembrane protein 176A
  ENST ID: ENST00000475536
  CDS Start-End: 1-534
ggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaaggggtgagtccctaagaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttccca

SEQ ID NO: 193750 - DNA, 469 bp, Homo sapiens
  Payload ID: 18261
  Gene Name: transmembrane protein 176A
  ENST ID: ENST00000468689
  CDS Start-End: 116-469
gaggaactccccacctccagccgcagcagcactctctgccagcctccctctgaacaggacaccgagccagttatgtcttcttacttagcgatgtgattctctggccttctcagtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgt

SEQ ID NO: 193751 - DNA, 635 bp, Homo sapiens
  Payload ID: 18261
  Gene Name: transmembrane protein 176A
  ENST ID: ENST00000461345
  CDS Start-End: 37-567
agactgtgtccctgacaatgggaacagccgacagtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaa

SEQ ID NO: 193752 - DNA, 1129 bp, Homo sapiens
  Payload ID: 18262
  Gene Name: transmembrane protein 176B
  Uniprot ID: Q3YBM2
  ENST ID: ENST00000326442
  CDS Start-End: 73-885
gtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaa

SEQ ID NO: 193753 - DNA, 1206 bp, Homo sapiens
  Payload ID: 18262
  Gene Name: transmembrane protein 176B
  Uniprot ID: Q3YBM2
  ENST ID: ENST00000429904
  CDS Start-End: 164-976
cccacctcagcctcccaaagcactgggattacaggcgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagca

SEQ ID NO: 193754 - DNA, 1006 bp, Homo sapiens
  Payload ID: 18262
  Gene Name: transmembrane protein 176B
  Uniprot ID: Q3YBM2
  ENST ID: ENST00000450753
  CDS Start-End: 76-777
cccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagc

SEQ ID NO: 193755 - DNA, 1430 bp, Homo sapiens
  Payload ID: 18262
  Gene Name: transmembrane protein 176B
  Uniprot ID: Q3YBM2
  ENST ID: ENST00000447204
  CDS Start-End: 374-1186
gctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaa

SEQ ID NO: 193756 - DNA, 1303 bp, Homo sapiens
  Payload ID: 18262
  Gene Name: transmembrane protein 176B
  Uniprot ID: Q3YBM2
  ENST ID: ENST00000434545
  CDS Start-End: 252-1064
cgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggtgaggccaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgccc

SEQ ID NO: 193757 - DNA, 1265 bp, Homo sapiens
  Payload ID: 18262
  Gene Name: transmembrane protein 176B
  Uniprot ID: Q3YBM2
  ENST ID: ENST00000492607
  CDS Start-End: 207-1019
ctcggggtcagctagtgtccgctctgctcggccgcgggctcccggaggactgcaggaggactcacgtaggagggagggacagctgggtgcaggtgtttctccccagaaaaacggctggagagcgggaggagaggcctggggctggcgcgtcccgtccaccttctgccgcctgcacgcctggaccctggctggagccctacggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaaga

SEQ ID NO: 193758 - DNA, 1394 bp, Homo sapiens
  Payload ID: 18263
  Gene Name: transmembrane protein 177
  Uniprot ID: Q53S58
  ENST ID: ENST00000272521
  CDS Start-End: 130-1065
gtgctttgcggccgccctgccgcgcgcacatgtaggcgttccgagcggcggcggaggtgagcgcacggacgagcgggagggacccttctccggcctgatgcgacccgattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 193759 - DNA, 1346 bp, Homo sapiens
  Payload ID: 18263
  Gene Name: transmembrane protein 177
  Uniprot ID: Q53S58
  ENST ID: ENST00000401466
  CDS Start-End: 82-1017
ggcgtgctttgcggccgccctgccgcgcgcacatgtaggcgttccgagcggcggcggagattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 193760 - DNA, 1216 bp, Homo sapiens
  Payload ID: 18263
  Gene Name: transmembrane protein 177
  ENST ID: ENST00000409951
  CDS Start-End: 97-423
aggcgttccgagcggcggcggaggtgagcgcacggacgagcgggagggacccttctccggcctgatgcgacccgattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgaaagggaacatcacagaaaggtgaagaaatttgccctaaatcataaaactttgtaagtggcagaacaaggatttgaagctggcagtctggttccaggtatcgttcttaaaacactaaatttatactgtcctatttagcctgaaagtttcatggtgcagacttatactgtggactccatagcccttttcctcatgctgggttagaagtaactttttcaggctcactatttttattaggaaaaaatagtcactgagcagaacttccgaggagacccctccagctaactgaagagaaagggacaaccagcctaccatgtttagtgcagcagggggaacaggacggaagggcagggtgtcatggagctctaggaggcaccagctgaggaaaggggatctcaggaggtagggagagagcagagtgggcagccagctgtgggttcaaatcctggcctaccactttaacagggcgatctggaacaagtgacttctggtcctgagtttcctgtctgtaaaatgggtgcattcctatctatctttcaggattgttttgacgatgaaagtgaaagaaagtttgcaaaatgtggagcctggtgagggcatatagtaggctttaaaaaaaagattgattttctaaatgttagtgctcctaaatggcataaggtgttcaggtcttggagttgctgcccaaataccagcaatttccagagaactcgctgctgcctaatacagctttattttaaagcttttcaaagccccagttcagttagggcagttttcccagtggctatcagttggcatcttctggaaggtacttggcagcagctgaaagcagaggacacatgtggcctta

SEQ ID NO: 193761 - DNA, 1738 bp, Homo sapiens
  Payload ID: 18263
  Gene Name: transmembrane protein 177
  Uniprot ID: Q53S58
  ENST ID: ENST00000424086
  CDS Start-End: 474-1409
ggcgtgctttgcggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 193762 - DNA, 791 bp, Homo sapiens
  Payload ID: 18263
  Gene Name: transmembrane protein 177
  ENST ID: ENST00000445518
  CDS Start-End: 450-791
gcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagaccta

SEQ ID NO: 193763 - DNA, 1662 bp, Homo sapiens
  Payload ID: 18264
  Gene Name: transmembrane protein 178A
  Uniprot ID: Q8NBL3
  ENST ID: ENST00000281961
  CDS Start-End: 57-950
attgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaa

SEQ ID NO: 193764 - DNA, 1286 bp, Homo sapiens
  Payload ID: 18264
  Gene Name: transmembrane protein 178A
  Uniprot ID: Q8NBL3
  ENST ID: ENST00000618232
  CDS Start-End: 9-344
gggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgccccc

SEQ ID NO: 193765 - DNA, 10558 bp, Homo sapiens
  Payload ID: 18265
  Gene Name: transmembrane protein 178B
  Uniprot ID: H3BS89
  ENST ID: ENST00000565468
  CDS Start-End: 80-964
cgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactccaccaacatgggcctctggaggaagtgccaccggcagggcttcgaccccgagatcgccgccctcattcggaaaggagaaattgagcgatgtacgtacatcaaataccactactcctcagcaaccatccccaggaacctcactttcaatatcacgaagaccatccgtcaggatgagtggcatgccctacacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccatcactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattatgactgttgtctctcttatcactgtagtggtttcatggccccagatagaggcccagagacctagaaattgtcatgagggacaggcctataagggtgccaattctgcagctacagatccctggagtggtgtgtgtgtgcgtgtgtgtgtgtgtgtgtgtgtgtgtgtgtgtgtgtggtggatgtttcttgagcgtggggttttattgtttgtgttgtgtttttttaaattgtttctggtatagctgaaatttccagagggcagaaccaagaacaaagccactgggccagaggacccccgtggttctccacattacagctctgggactctgcacgatttagtcctctaattttggaagttcaagacacagctgggcacataagccatgagagaagagggggaacacacagttcaggagagagaagaaatgttgctctggttgctgttgtacaagaacataaaccaacaagaccttcactccccattatagaagctgtcctttgtcactggacatctcccctttccctaggggtgacctctgtacaaacgaaaggaagtgggtcacatgcagagagagcacctccatttcccatgggctcaagtttgtatgatattgtgtaaattaatgcagaactcttgactctttccatcctcttcctttccctcttgatattcaaggccatgaatcccaaaataacagtcttagtggctagcacccaaacagaggtggaataaatccaccccagtgtctcgggctcatttgagcaaattagcactgcaggtgctggcaagcaaagtcagccagagagttgtgaacgctgtaggggtgggagtctgctggagtgggctggagccgctcacagtcatctcagtgagcctgctggtgcccagcagccctggggaggccaggtgagaatccctgagctggtgtagccatggtcaactgtgtagcagagaatccccttgtttcataaacaaatatgctttgggagctttgccaggcactcagcagcctttcttccactgctgtgtaatctgtttcatttacacgtcttccaacccatcttcctaccactctcctccttttctcacctactaaccacttaccttctctctcttctatcttccaccctcatctgctcctttgaactgcgtgtatgtaattcatatctggatatgatatgacatctgatgtgcatgaatggggttgaatgtggatctctctgtatgtgtatctctctggtgcattttgtgtacgtttgtgtcagtacacacctgcacacaggtgtgggtgccctactcaagacttccttaccggggactctggtcagcttctgcaaaaggtctcatgtgtgagttccctgtgtgtgggtgtgctgggcgatagggtaaggtgtgcaacgggaaaagttgttagcttccagttggggttctaaggattatttttaaaacaaaggatttattctatgagaagggaaataattttcaggaaaacccagtttttcaattgggcattttatttctaattttctttgaaaagttagatttctcccttaaggggaagggcatacttgggcttaaggaaaagtgaagaaaagtatctcagattgagaggccttttgtcttccttccaagcgtcctgaaggggctctgccgaggaagggacagacaggttcacaagcatccatttgggggagagggcttgtctatgaccacactgaaattccagcttttttccagttgcaggagagaggggaaaaattctaaatggggaaatttgctatgaaccatttaaactttttgtaagtaatcatgtttgaggatgctggctcacagacctatcattatttatatcctctttttaaaaaaaaatcccatactttcaatgaatagattatctgctctatccaattattgtctttgtgacagacatttagcaaagcttactgcatccctttgaaaccttgagagttcctgaaatgttagaaagctcccaggaaagacgtaaacaacctgggctcaactcaccagcccagagcaggggctttgagtgacttctttgatagcaggaccagataaatacgaacacactttgggatctgatcctgctgggaagcaaaagacgcccagccacatgaccaggatagaggcccctttcagacggcaagtcctggccaatgggaggacttctcaggtgaccttgatccctctagcataagggcttgaccacagattaaaacatgtgactccaaccagttacggaagctttctggctgtgaggtagctgagggagatgaggaggaggaagagaggagccttgacttgtgaggctctgtaggtcagactctgctaactccaaatcaaagtggaacccaaccttatgagggcatttagggtcaatgacctcactaaagtcaccagccgcaaccccaggtcaagttcaaacttcttactggcatatgaacatgtatgtgctttgagctccatgcaagtcaaccttgagcctggggcccattgcaacttttatttccttccctactctactaccttgagattcaggaaagtgaggtattctacctagagagaggtcccatatctttttctccttattttgggagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcagggatgagtggtcccacctagcaatgcttgcctctcctgtgacaagagggtaggatatcctaggactctgagactgggccctatatctcaatattcatccacactcatgataagatgccggaaatgaatgcactgtgtgtagctgtcttgatttagtgggaggatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacaagatttttcataatccagtcactctgaggcatctaccgcgggcccaatccaaatggtcatgacctcaaaacttccccaatgagtgcttgtctctgggttggcagctggggccatgtgagcagtgtacaccacagaaccgcactggtctgcgttgagttgaccctgtgttcctggcagcaagagtgcagggccctgagcccccagagatagcaaagaggcctaaaagtttaatgccagaccttaggggcaggatggagcagggctaaaagatgtctctttgggcctgtctgcctgctttccttccttccttttctttcctttttttttttggtcagttgccatctcaatctaatcatagatgtaagaatgcggaagccagagtaactcactcattaagctacacttgtgtaacagttactgtaaatttcactacagctctgcactgaaatgatttgtgactctgggcactgtgtcttctccatacttgaacttcctcatctacaaaatgaggataagtgataacaccttacctcatggtatattaagggtgacaaagaaattgcaaagtgatttgcaaacatgaagtgtcatatgagttatgtatgttctaattatccctcagaagaccccccgctggaatggaattctcacatcaagtgtctgtgcctcgctgctgaaggataacccagagtgcaaggtcatctttgttgctgaacagggctggacctgtcgcacttaagcacacttaaaggattctattcttcattcaggtcccccagagaaattggctccttatttttctttacctattcctagacttccttttgtctagagccagttttgcaaagggcacttttatccatctcagttattcccagaggtgacagaatgagtaaaccatatggggcaaatagcatatatgagctaaaccagttaactgttaaccaaggcacatggtcaatgccttagtatttttttttttaattctcctaacgttatttctagctgtacattcccaaaaggaatgggtggaagcaaatcagattctgaaaggtttcaatgatctttcaagtttaggatgagaccaagtctcaaggagctgggatcttctttctcttgtcagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgagggtgagacttccttcaagggaagggaagccattgctctctctgtagatagagcccagctggtaacgggggagccacccaactgcaggggggtgtatgttcaggtgtgaaaaacagaaaactgggtctgaacatgaagagttgcacagcagtagttcgaagaagctggcatctctttggcaaacaccaacctcagcaaatgcaactcctacacttcattcccaaggaccaggtgttgctccttaaggaactctgtatccctctctcctctccagaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgtagcccttagttttctgaggacttctgtggacggccctaaaatcctgagttagggtgggatatgaagggagggataccattgacacaggaggtttttttctggttgtttctctcacagtcatcagtgtctgcttagaactctctgttctaaaggtttttccctgtaaagtagaatgcacttcccccaaaataaaagtaaatcagcaatgtttgaagggtcatggcaagggtcatgacaaagacctgactctggggtggcatgagtggccctgtcaccggctcactcagggccttgggggagtctcattacctcaccttgtctccacgtcttctcagccaaatggggatcaggggcttccagggctctgggggtgcgcagtccccttgtgtattttgctgctatttctagagagactttgagcccttgctagtgcgtgcttactgcatggaggtaaattaggagatgttttctctctgctactcctggcctctgctttcgcccctcagaaagtgaccttgagctagcagccagtttgcactcagagtccagagccttctatctaccgtttcattctcagattccttttcccacccactttgacgatctcattttactatcagtctctactgactgagctttgctgcactgggctggggtaggagaaagagcatccaaggagatgatgtgtgaattgctttgtaatttatgactcaccatataaatgtggcttgcagtgtcagaagcagggagtctggccaagggttgctaccaaataagactgaagatggtggaggcagtggtggcgtggaggcagtaggcagaagatgtgggttgggagcagaggtaagatgaacggagctttgggaaggacagatggcagaagcaccagaaaatcctcagcaaggcagcagagaaggatcctcaaagcagtaaccctgaagtaataggaagtaggaaagaggagcagggattaggtaaatctgcagcataaacagctgtctccctgcaggactgagaagaccagctgccccagagaggggaggcacgtcgagcttggccagtgacccaacccatgattagaggcaccttcaatcccaactttcctctcctctgctgggtcacagtgatggaaccagcttcaggaaggtagtatagaccagcgtcatccaatggaaccatgatccaagccacatatgcaatttaaaatattctagtagccacattttttaaagtccaaagaaacagctaaaatcagtgaaattaatttttagactacattttaacctaacatgtcaaaaatagtatcacttcagcatggaatcaatataaaaattactgggatattttacattcttttttccaaatgaagtcttcaaaatccaatgtgattttcctcttagaaaacatctcagtctggcccagccctatttccagtgttcaatagccacacctgactactggttgctgtataggacagcacggacttaggttcttcattaggagactgatggggggggtccttcctggtgggtcactcactgccatagctcttgtcatagctgatgaaggcaggagtgagtcttattatgttggcctagagtagaaagcacagagctatgtcgaggctgctgtctcagcctctggaagttctgcttcacctgcttagtaagaggagatgaccactcctgtggactgcatgtcccatctgcccccagagggtgtcggcgctgccccagtcatgtcccttatgacctgtccaagtcctagaggccaaagcaggtcatattcttcagctgcaggaatgtcagctactgcctcccaccccttaacctgatccccttatcatatagtggggaaggggcaggcaggccttctctctgtcaagaacaaagatctctacaacatttcgtcacctgggccagtcacctgctaatatcatctcaccaatatttggagctgttttctgaatcccttaattttcttaaatatttatcttaaagtcaaatgctataaaggagataccctgggaagggcagtggccacaggcagactgggtctcctaggaggtggtggtgttggtgacaagttctacttggactgggactcaacccaccattgcctacctctcttccctgcctggagaccttccttaggattgaagaaacctcttttgtttgtgaaaaagataggtatcgagatcttaatggagagaacagaataaaatgcaaggagccaacccctgggtattctcaaagcatttcaacggtcagtataacaaggtttgattgatttaaaatataacattctgagccctgtgttactgagcaaaaatgagctgatttggtgagtatgttttatatatggtcattagacagggaccataactgacaaaactctcaaacgcctggagtgtttatggcccaccagattattgctcagtcaatataaatttatttacctttattttaatttgcatagtgctttctgattggtcagacaaggagtggtgtgtactgcaggattctaacaatgcctctgcccttggaggcagcaattcctgtggttattggtgctaaaataagataaaatattatgttaatttgttctgatatgatgtgaataaatgtgttgtttaatcttaacaagaatgctacatcttatcagatctattgtactgtctgttccttctcataattaattaattacaggaaaggcgattcaaaccagatcttgaaactattgtgatgttctgagaggtaaatttaacagggaagtgggaggggggatgaaaagggaaattgccaggttcctgtgactttgaaaggactgaggaagcagagagcatttggggacttcactgaaactgactgcatcttgcaattttctttttcgaattggcagaaatattgtatttccattgattgaagaaaaacaagtgtctggtaattaattaaatgacttgttcatggaaaaaataaataatctgtcagttgtggaatgtaaactgattaaacaattaaataaagaagattatgttgtgtgttttaaa

SEQ ID NO: 193766 - DNA, 10552 bp, Homo sapiens
  Payload ID: 18265
  Gene Name: transmembrane protein 178B
  ENST ID: ENST00000610315
  CDS Start-End: 80-958
cgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactccaccaacatgggcctctggaggaagtgccaccggcagggcttcgaccccgagatcgccgccctcattcggaaaggagaaattgagcgatgtacgtacatcaaataccactactcctcagcaaccatccccaggaacctcacttttaacgtgaccaagactttgcgttgtatgtactgtatgtacctgcgcagaatgacggctggcttcatgggcatggcggtggccatcatcctctttggctggatcatcggcgtgctgggctgctgctgggaccgaggccttatgcagtacgtggcagggctgctcttcctcatgggaggaaccttctgcatcatttcactgtgcacctgtgtggccgggatcaactttgagctgtcacgctacccacgctacctgtacggactccctgatgacatcagccatggctatggctggtccatgttctgtgcatgggggggcctgggcctcacactcatctcgggattcttctgtaccttagccccttctgttcaacctgtcccgaggaccaactaccctaaatccagacccgagaatgggacagtgtgctaaaaaacaaacccatacatacatatatatatataaatatatatatataatatacatatataaaacaaaacaaaactaaatcaagacgatgccagtgccaaggtagagttgagttggctcaggcacctgcatctcgccggactttgtgttgcctcatctctgagatggggaaagtttttccatcctgtggctcttccatcagttcttgacttttggcttcatggtctcttgaagacagagcaaacaccaccacttgcgaccgcgtcttgatccccatcactggcgaggatggggtggtgaagggacagtggaaggggtctgaggcagcacagatgtagagaaggaagtgccacccactgggtcaacgggagaggacgccacccctaaccagtcatatcacagggtaacaaagccctcagttcctagaatgtaaccaaattattgaggccattttcagaatcacttcttctcctgctcttcctgttcggacttccttcccagcccaccagcaacacacaaggagtggaagagaaaacaaactgagaaggacgttttctctttgctgccaaacttttggaccatgtttcataggtgggaagggaagagaacatgctgagaggcaagatctgcatcaatgaaaggacgcttcggtggatgctcagacaacccagtcttaccttccagctgccttacacccagtgaaacaagaggccaccctgtccccagccgcacctgcactccctgggcagactggagccttggagtcatgctgtgatgtgtgtgtgtgggtgtgcgtgcatgtgtactttgggcggtttcctttttttcttttctaccttttaaatggaaatactgcattatgactgttgtctctcttatcactgtagtggtttcatggccccagatagaggcccagagacctagaaattgtcatgagggacaggcctataagggtgccaattctgcagctacagatccctggagtggtgtgtgtgtgcgtgtgtgtgtgtgtgtgtgtgtgtgtgtgtgtgtgtggtggatgtttcttgagcgtggggttttattgtttgtgttgtgtttttttaaattgtttctggtatagctgaaatttccagagggcagaaccaagaacaaagccactgggccagaggacccccgtggttctccacattacagctctgggactctgcacgatttagtcctctaattttggaagttcaagacacagctgggcacataagccatgagagaagagggggaacacacagttcaggagagagaagaaatgttgctctggttgctgttgtacaagaacataaaccaacaagaccttcactccccattatagaagctgtcctttgtcactggacatctcccctttccctaggggtgacctctgtacaaacgaaaggaagtgggtcacatgcagagagagcacctccatttcccatgggctcaagtttgtatgatattgtgtaaattaatgcagaactcttgactctttccatcctcttcctttccctcttgatattcaaggccatgaatcccaaaataacagtcttagtggctagcacccaaacagaggtggaataaatccaccccagtgtctcgggctcatttgagcaaattagcactgcaggtgctggcaagcaaagtcagccagagagttgtgaacgctgtaggggtgggagtctgctggagtgggctggagccgctcacagtcatctcagtgagcctgctggtgcccagcagccctggggaggccaggtgagaatccctgagctggtgtagccatggtcaactgtgtagcagagaatccccttgtttcataaacaaatatgctttgggagctttgccaggcactcagcagcctttcttccactgctgtgtaatctgtttcatttacacgtcttccaacccatcttcctaccactctcctccttttctcacctactaaccacttaccttctctctcttctatcttccaccctcatctgctcctttgaactgcgtgtatgtaattcatatctggatatgatatgacatctgatgtgcatgaatggggttgaatgtggatctctctgtatgtgtatctctctggtgcattttgtgtacgtttgtgtcagtacacacctgcacacaggtgtgggtgccctactcaagacttccttaccggggactctggtcagcttctgcaaaaggtctcatgtgtgagttccctgtgtgtgggtgtgctgggcgatagggtaaggtgtgcaacgggaaaagttgttagcttccagttggggttctaaggattatttttaaaacaaaggatttattctatgagaagggaaataattttcaggaaaacccagtttttcaattgggcattttatttctaattttctttgaaaagttagatttctcccttaaggggaagggcatacttgggcttaaggaaaagtgaagaaaagtatctcagattgagaggccttttgtcttccttccaagcgtcctgaaggggctctgccgaggaagggacagacaggttcacaagcatccatttgggggagagggcttgtctatgaccacactgaaattccagcttttttccagttgcaggagagaggggaaaaattctaaatggggaaatttgctatgaaccatttaaactttttgtaagtaatcatgtttgaggatgctggctcacagacctatcattatttatatcctctttttaaaaaaaaatcccatactttcaatgaatagattatctgctctatccaattattgtctttgtgacagacatttagcaaagcttactgcatccctttgaaaccttgagagttcctgaaatgttagaaagctcccaggaaagacgtaaacaacctgggctcaactcaccagcccagagcaggggctttgagtgacttctttgatagcaggaccagataaatacgaacacactttgggatctgatcctgctgggaagcaaaagacgcccagccacatgaccaggatagaggcccctttcagacggcaagtcctggccaatgggaggacttctcaggtgaccttgatccctctagcataagggcttgaccacagattaaaacatgtgactccaaccagttacggaagctttctggctgtgaggtagctgagggagatgaggaggaggaagagaggagccttgacttgtgaggctctgtaggtcagactctgctaactccaaatcaaagtggaacccaaccttatgagggcatttagggtcaatgacctcactaaagtcaccagccgcaaccccaggtcaagttcaaacttcttactggcatatgaacatgtatgtgctttgagctccatgcaagtcaaccttgagcctggggcccattgcaacttttatttccttccctactctactaccttgagattcaggaaagtgaggtattctacctagagagaggtcccatatctttttctccttattttgggagttacggtttcttcttctgtttccgtttcctctctctctactcactcctactttctcctgcatcaactttggtcaattaacatagacaagtgattcatctgtagagaggctcctagactccaagcagcccccttccttgttcattgtggctgtaggttttataaggaggtctgtggctccctggcatcaaaatatgaaaaataaaatctgtgcctgttccagcttcaatcctcctccaagccttagcttttcaacaaccctaccctttcaacttcagggatcatggagtcacagagactggacaactcctccaaatctagacaaagactttcttaagcgccctgagcccaggtgcatatcttcccatcagggatgagtggtcccacctagcaatgcttgcctctcctgtgacaagagggtaggatatcctaggactctgagactgggccctatatctcaatattcatccacactcatgataagatgccggaaatgaatgcactgtgtgtagctgtcttgatttagtgggaggatgtgctgcttaggtctccaaagatgcccacctgggtcaaattcagaataatgaactcaggtacatcacccagaggcatttagaatggactctctcttcacctggattatgtgctgagtgttaagtgatttttcaaatatctgggggaaggagtgggaagagatacactctggtcatcctttggtgtggtttgtgggggatacttggttgattcttgtagttaaagtgaagttgcttttctgaaaatgttccctgtcttcaggggacttacccatcccaggggacacatccatcccaggggacacagccagccctttccagggaaatacgatgtttctgagtgagaggtgatttcagtgcagataggaagagctggtgcacaccagcagggttgccttccatgccatcttccagctggtgtgggatagactaagggggcagatttttaagaaccccaccagagttgacatacacacgtgattctcgtgtctgtctctcaaagctctcaatgtctggggctgtgtttgccctcttttcattgatgctgccatgatgcaaaatgtttcttaaacattattcctggttcttagaatatgtgattactgagtattggatttctttcctgaataataactgctcattgtagaaaataagaaaaataaaatacaaaaaagactacaagatttttcataatccagtcactctgaggcatctaccgcgggcccaatccaaatggtcatgacctcaaaacttccccaatgagtgcttgtctctgggttggcagctggggccatgtgagcagtgtacaccacagaaccgcactggtctgcgttgagttgaccctgtgttcctggcagcaagagtgcagggccctgagcccccagagatagcaaagaggcctaaaagtttaatgccagaccttaggggcaggatggagcagggctaaaagatgtctctttgggcctgtctgcctgctttccttccttccttttctttcctttttttttttggtcagttgccatctcaatctaatcatagatgtaagaatgcggaagccagagtaactcactcattaagctacacttgtgtaacagttactgtaaatttcactacagctctgcactgaaatgatttgtgactctgggcactgtgtcttctccatacttgaacttcctcatctacaaaatgaggataagtgataacaccttacctcatggtatattaagggtgacaaagaaattgcaaagtgatttgcaaacatgaagtgtcatatgagttatgtatgttctaattatccctcagaagaccccccgctggaatggaattctcacatcaagtgtctgtgcctcgctgctgaaggataacccagagtgcaaggtcatctttgttgctgaacagggctggacctgtcgcacttaagcacacttaaaggattctattcttcattcaggtcccccagagaaattggctccttatttttctttacctattcctagacttccttttgtctagagccagttttgcaaagggcacttttatccatctcagttattcccagaggtgacagaatgagtaaaccatatggggcaaatagcatatatgagctaaaccagttaactgttaaccaaggcacatggtcaatgccttagtatttttttttttaattctcctaacgttatttctagctgtacattcccaaaaggaatgggtggaagcaaatcagattctgaaaggtttcaatgatctttcaagtttaggatgagaccaagtctcaaggagctgggatcttctttctcttgtcagttgctgaagccagtagcttcgtcaaaaacatatgaattcatataaggaagccctttagatggtacattcactaagacgtgtctgggtgtgatcctgtttgggaaaaacagaatcctaggttctaaacaagaaaagaacgcccttcccaaagggtccgcacactttctgctttgcagcggatcaagtgtccttgtgagggtgagacttccttcaagggaagggaagccattgctctctctgtagatagagcccagctggtaacgggggagccacccaactgcaggggggtgtatgttcaggtgtgaaaaacagaaaactgggtctgaacatgaagagttgcacagcagtagttcgaagaagctggcatctctttggcaaacaccaacctcagcaaatgcaactcctacacttcattcccaaggaccaggtgttgctccttaaggaactctgtatccctctctcctctccagaaccccattcctcccactggctgagcttttcctttcctttccgggtcacccatagaccctctccgtctgtaccagtgcgtctgtgttgtgagcgtgacgaagcctttcctgtgaagagctttcatgaactcattctcatactccttccccatttccacccatggtgtgactgttttgctattcaagactatctgtaaaaatgtacaaataaaagtgaaaactgaaaataaaggggagggagattgagattaaacaaatgcaatgatgtagcccttagttttctgaggacttctgtggacggccctaaaatcctgagttagggtgggatatgaagggagggataccattgacacaggaggtttttttctggttgtttctctcacagtcatcagtgtctgcttagaactctctgttctaaaggtttttccctgtaaagtagaatgcacttcccccaaaataaaagtaaatcagcaatgtttgaagggtcatggcaagggtcatgacaaagacctgactctggggtggcatgagtggccctgtcaccggctcactcagggccttgggggagtctcattacctcaccttgtctccacgtcttctcagccaaatggggatcaggggcttccagggctctgggggtgcgcagtccccttgtgtattttgctgctatttctagagagactttgagcccttgctagtgcgtgcttactgcatggaggtaaattaggagatgttttctctctgctactcctggcctctgctttcgcccctcagaaagtgaccttgagctagcagccagtttgcactcagagtccagagccttctatctaccgtttcattctcagattccttttcccacccactttgacgatctcattttactatcagtctctactgactgagctttgctgcactgggctggggtaggagaaagagcatccaaggagatgatgtgtgaattgctttgtaatttatgactcaccatataaatgtggcttgcagtgtcagaagcagggagtctggccaagggttgctaccaaataagactgaagatggtggaggcagtggtggcgtggaggcagtaggcagaagatgtgggttgggagcagaggtaagatgaacggagctttgggaaggacagatggcagaagcaccagaaaatcctcagcaaggcagcagagaaggatcctcaaagcagtaaccctgaagtaataggaagtaggaaagaggagcagggattaggtaaatctgcagcataaacagctgtctccctgcaggactgagaagaccagctgccccagagaggggaggcacgtcgagcttggccagtgacccaacccatgattagaggcaccttcaatcccaactttcctctcctctgctgggtcacagtgatggaaccagcttcaggaaggtagtatagaccagcgtcatccaatggaaccatgatccaagccacatatgcaatttaaaatattctagtagccacattttttaaagtccaaagaaacagctaaaatcagtgaaattaatttttagactacattttaacctaacatgtcaaaaatagtatcacttcagcatggaatcaatataaaaattactgggatattttacattcttttttccaaatgaagtcttcaaaatccaatgtgattttcctcttagaaaacatctcagtctggcccagccctatttccagtgttcaatagccacacctgactactggttgctgtataggacagcacggacttaggttcttcattaggagactgatggggggggtccttcctggtgggtcactcactgccatagctcttgtcatagctgatgaaggcaggagtgagtcttattatgttggcctagagtagaaagcacagagctatgtcgaggctgctgtctcagcctctggaagttctgcttcacctgcttagtaagaggagatgaccactcctgtggactgcatgtcccatctgcccccagagggtgtcggcgctgccccagtcatgtcccttatgacctgtccaagtcctagaggccaaagcaggtcatattcttcagctgcaggaatgtcagctactgcctcccaccccttaacctgatccccttatcatatagtggggaaggggcaggcaggccttctctctgtcaagaacaaagatctctacaacatttcgtcacctgggccagtcacctgctaatatcatctcaccaatatttggagctgttttctgaatcccttaattttcttaaatatttatcttaaagtcaaatgctataaaggagataccctgggaagggcagtggccacaggcagactgggtctcctaggaggtggtggtgttggtgacaagttctacttggactgggactcaacccaccattgcctacctctcttccctgcctggagaccttccttaggattgaagaaacctcttttgtttgtgaaaaagataggtatcgagatcttaatggagagaacagaataaaatgcaaggagccaacccctgggtattctcaaagcatttcaacggtcagtataacaaggtttgattgatttaaaatataacattctgagccctgtgttactgagcaaaaatgagctgatttggtgagtatgttttatatatggtcattagacagggaccataactgacaaaactctcaaacgcctggagtgtttatggcccaccagattattgctcagtcaatataaatttatttacctttattttaatttgcatagtgctttctgattggtcagacaaggagtggtgtgtactgcaggattctaacaatgcctctgcccttggaggcagcaattcctgtggttattggtgctaaaataagataaaatattatgttaatttgttctgatatgatgtgaataaatgtgttgtttaatcttaacaagaatgctacatcttatcagatctattgtactgtctgttccttctcataattaattaattacaggaaaggcgattcaaaccagatcttgaaactattgtgatgttctgagaggtaaatttaacagggaagtgggaggggggatgaaaagggaaattgccaggttcctgtgactttgaaaggactgaggaagcagagagcatttggggacttcactgaaactgactgcatcttgcaattttctttttcgaattggcagaaatattgtatttccattgattgaagaaaaacaagtgtctggtaattaattaaatgacttgttcatggaaaaaataaataatctgtcagttgtggaatgtaaactgattaaacaattaaataaagaagattatgttgtgtgttttaaa

SEQ ID NO: 193767 - DNA, 2513 bp, Homo sapiens
  Payload ID: 18266
  Gene Name: transmembrane protein 179
  Uniprot ID: Q6ZVK1
  ENST ID: ENST00000341595
  CDS Start-End: 907-1500
aataaaacaaaaatattttttaatgcttgcaacaaaaatgctgatggaattttaaaccaggaggagcaatgttaaggcttcctcactctgggaattggactaaaggtgacttagtcttaaaggcaactagaaaaggcattaattctattaattaatgcctcagcgatttccatctcagcaaagatgtcttaatgaggcgctcgggacacccattatttatcttacaaatgcagctccagggtcctgcccatgtcaggcagtgtaacacacgtccccgcggagggctggcgctgcagaagctcccggtccaccccctcctgcccacacctggcctcaccctccccatctcttcgaggatgacctctgtcccagtcccttggaccccgactcctccacgatctggcccctcccctcatacattgcatttcgggacccccgcaaaggaatcacttcagcctggactgcaaaccgcactcctacacctcactatgagcaccttgggggtgtcctccaacaccccccgccccgccctctctctcctggtctcctttcgttcgagctgatgaggaactgacgacccagagtcggcctgtgtgaggcccgtacaggtggctcccgaagtctttagcggcacagggtcggtccctccaggccgacctggtaaaattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtagggggctctgggcaagaagggaggcttgcaatgctgggagggggccatttactgctggacatttgctgagctctcccccatccagaggaggaggcaggctcctgtgtggataaggtagttagcaatgggaccaggcagtgggagcagtcgggaaggcttcctgcaggaggtgggggagagctgggcttttgtaggtgggtttggggaggagatggccacagtgagttagaatcaggaagtggcaaggccctggggtctggggtgggaagtgtgggggtgtggggggaggtggtgccagaaacgaaaccaggcatcagatcctgggggtccagtgtagggacaagggctttggactttggtgctggcgctgggtgggcctgttcagatcagagctggaggcttagaggagtcccctagccagggggaagctgatacagagtccaaggaaggaggcaggggatcccacttgtgaattcagatttgccaccctgcccttgtataagctgcgtcccccgccccctaggagacttggtggagggcgatggtggcccccactctgagggacgctatttgctgaaatgcaggcatgtggggacacatcagtggcccgtgagggccggagggggaaccctggaattgggtttgccccttgaaatctgcagatgtgccccagacggagatgaggcagatgaggggtgccgggtgggggtggctgagaccagacacctggctcctgccagcactgatcagggcccgctggcttcaggtccaattccggaccccaggctggcctctgaaggctcttgctggccgtggctggcctgaggacgcttctcctggccaggagccctccaagggtgctggacatgggtgggcctgaatgctctttgccgagatgaactggacctgtcaaagacaccttcatgcaaatttagtgagtggaagaggcctcaggcctaatttgtgccagttggattaaggtgtgagtgcagtctgatggcaaatacgctcaaatgagaatcagcttaatgtagctcaggcctggttctgattaaattgtttctccttcaactgtttggaaa

SEQ ID NO: 193768 - DNA, 588 bp, Homo sapiens
  Payload ID: 18266
  Gene Name: transmembrane protein 179
  ENST ID: ENST00000415614
  CDS Start-End: 19-588
ctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagggttccctgattgactcacatggcgtggagactcctcccgggcagtcc

SEQ ID NO: 193769 - DNA, 1430 bp, Homo sapiens
  Payload ID: 18266
  Gene Name: transmembrane protein 179
  Uniprot ID: Q6ZVK1
  ENST ID: ENST00000556573
  CDS Start-End: 243-944
aattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagtttggcctctgggcctcatggctggcctggctggccatcaccacgctggccttcctgaaggtctaccacaactaccgtcaggaggacctgctggacagcctgatccacgagaaggagctgctgctggcccggccgtccccacgcacctccttccaagaggagaagagcgctgtcatttaggcacagtgcaggcagggggagctggccccgacctccctgctgcgctcgggggcacgggcctgcctggggaagcagctggggggctctgcctgggccctggccacatgcagccctgcgtgtgtcccctcgacgccacgtgtagtgaggtgagcgccccagtgcccacctgtgagcctggcagtggactgggtgggtgccggctccctgatgaggatggtgcagagagactatgggtgtggggcgggggcggggggcacctccaggcctcgcacagggccccttggctgtcccagtaggacctgactggccagcctatgtggagggcgtccagcttgtctcccccaaccctggccggatgctgtctccatgccagctggcccaggggtggccagatgtcacttagccctgaacgaattctgcatgaattctgccatccaggcagaggctgcgtgtggggaggagctcacggcaccttccagcctctgg

SEQ ID NO: 193770 - DNA, 815 bp, Homo sapiens
  Payload ID: 18266
  Gene Name: transmembrane protein 179
  ENST ID: ENST00000556320
  CDS Start-End: 1-235
gcctgatccacgagaaggagctgctgctggcccggccgtccccacgcacctccttccaagaggagaagagcgctgtcatttaggcacagtgcaggcagggggagctggccccgacctccctgctgcgctcgggggcacgggcctgcctggggaagcagctggggggctctgcctgggccctggccacatgcagccctgcgtgtgtcccctcgacgccacgtgtagtgagccctgacccactggacatggggactctttccagtccggagagctccttgtctgtgtccccagcagaaggtggggtggctcctgcctcaccctctgcccagccctgatccaggccacagccatctagggccctgaaggaggggcaggaggcaggggtggcttctggaacctgaggcttggccccggttgggtctgttcttgggggctgcactgctggatcccaggagcaggtgtggaacagccccatggccagggtgatggaaatcctcggctgcatgcagacatagacccaccctggactgggctgtctccggagcccagacacatcgccctgggaaggggcagctgggcctgcagtgtgctgggcaggggctggcggccctggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagctta

SEQ ID NO: 193771 - DNA, 1645 bp, Homo sapiens
  Payload ID: 18266
  Gene Name: transmembrane protein 179
  ENST ID: ENST00000620158
  CDS Start-End: 332-880
gtgagggtgtgactgagtgcatgagagtgtgactgcctgtgagtgaatgtgtgactgcatgtgcgagtgactgcctgggaggatgtgattgtgcatgagtgtgcatgtgggtgtgactgcatgtgagggtgtgactgttgtgcgtgtgaaggcttgattgtgagtgtgcctgggaggatgtgagtgtgagggtgtgactccctgtgacatgagtgtgcatgcatgtgagtgtgaggaagagtgtgtaggtgtgagtgtctaggcaggtgtgtctgcagtgtgtgcagcatgtgcgtaagtgcatgtgaatgtgcgtgtgttgcatgtgagcatgtgcacgcctgtgcgtgtgagcattgtgtgcgtgatgggagccgtgggtgctgtgtggacagcccctctgcccctcccatgggctcccacgcccagcatccacctgagagaggagggagctgccttcccattctgcagagtctgtgtgctgaggccccgcagaagcaagtggaggagctgggatgtgaacctgggaccccggcgtagggggctgcttggctgtggaccctgcccctcaggaaagcccagggtccacctccagaggactcgttctggggcgggggcggaggcggggggcctccccacccggggctcgatgaggggctgtccgtttcttggctcgagtgctgccaagtgctccctgctgctgcgcccaccttcccggggagaggcgagcccctggctccctgagttcatgacccaccctgtccaccatcagcagctggcttgtgtctctgggtggctgggcaccagcctcctggaggccacgtgcctgggtccacatggagggtcctggtgggggcatcatcctgggtcccgggagtgaggctggcaggtgcccatcgggggtgtcaagtccagggggatcgaggctctggaagctcaagggggctctggccttggggaccagctgagtttccagctggcagccaggtcctcgagggaaggggtttggacagaatccgaggccccctaagctgatggggtcccctgtctccccttccagccctgacccactggacatggggactctttccagtccggagagctccttgtctgtgtccccagcagaaggtggggtggctcctgcctcaccctctgcccagccctgatccaggccacagccatctagggccctgaaggaggggcaggaggcaggggtggcttctggaacctgaggcttggccccggttgggtctgttcttgggggctgcactgctggatcccaggagcaggtgtggaacagccccatggccagggtgatggaaatcctcggctgcatgcagacatagacccaccctggactgggctgtctccggagcccagacacatcgccctgggaaggggcagctgggcctgcagtgtgctgggcaggggctggcggccctggtcgtgggctctccagggtccctcaggggattgggcctctccccaggcaggaaggtgggaagtgcaggcatgacccggggttcctgaggctggtccaccaagttgcttctgagacgccttcgcttctgtcctggctggctgttaatgatatccctgttctaattccactctggctaaactgaaagtaaagatccttaagctt

SEQ ID NO: 193772 - DNA, 1645 bp, Homo sapiens; identical to SEQ ID NO: 193771
  Payload ID: 18266
  Gene Name: transmembrane protein 179
  ENST ID: ENST00000616017
  CDS Start-End: 332-880

SEQ ID NO: 193773 - DNA, 586 bp, Homo sapiens
  Payload ID: 18266
  Gene Name: transmembrane protein 179
  ENST ID: ENST00000615269
  CDS Start-End: 19-586
ctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagggttccctgattgactcacatggcgtggagactcctcccgggcagt

SEQ ID NO: 193774 - DNA, 636 bp, Homo sapiens
  Payload ID: 18266
  Gene Name: transmembrane protein 179
  ENST ID: ENST00000615704
  CDS Start-End: 1-636
atggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtccaattccggaccccaggctggcctctgaaggctcttgctggccgtggctggcctgaggacgcttctcctggccaggagccctccaagggtgctggacatgggtgggcctga

SEQ ID NO: 193775 - DNA, 636 bp, Homo sapiens; identical to SEQ ID NO: 193774
  Payload ID: 18266
  Gene Name: transmembrane protein 179
  ENST ID: ENST00000621393
  CDS Start-End: 1-636

SEQ ID NO: 193776 - DNA, 1430 bp, Homo sapiens; identical to SEQ ID NO: 193769
  Payload ID: 18266
  Gene Name: transmembrane protein 179
  Uniprot ID: Q6ZVK1
  ENST ID: ENST00000630378
  CDS Start-End: 243-944

SEQ ID NO: 193777 - DNA, 815 bp, Homo sapiens; identical to SEQ ID NO: 193770
  Payload ID: 18266
  Gene Name: transmembrane protein 179
  ENST ID: ENST00000625459
  CDS Start-End: 1-235

SEQ ID NO: 193778 - DNA, 2513 bp, Homo sapiens; identical to SEQ ID NO: 193767
  Payload ID: 18266
  Gene Name: transmembrane protein 179
  Uniprot ID: Q6ZVK1
  ENST ID: ENST00000625335
  CDS Start-End: 907-1500

SEQ ID NO: 193779 - DNA, 1023 bp, Homo sapiens
  Payload ID: 18267
  Gene Name: transmembrane protein 179B
  Uniprot ID: Q7Z7N9
  ENST ID: ENST00000333449
  CDS Start-End: 6-665
gcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatcttagtagtgagtttttgatgttaaagtacaactagataggaggaaggagtgaaggctaagcagacatggactgaaacttagaggtactgttaggcagctgccctagggatgactgctcctttatttgttgttaatgaatcttgacctccttgtgtgaccctg

SEQ ID NO: 193780 - DNA, 797 bp, Homo sapiens
  Payload ID: 18267
  Gene Name: transmembrane protein 179B
  ENST ID: ENST00000533861
  CDS Start-End: 18-452
ctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatctta

SEQ ID NO: 193781 - DNA, 400 bp, Homo sapiens
  Payload ID: 18267
  Gene Name: transmembrane protein 179B
  ENST ID: ENST00000526546
  CDS Start-End: 1-286
gctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaagtgagacccaaggataggaggaaaaactgacataaatatctgtagctgtgtgggtgctcaccagtgtattgtgagcttggcctaccagtgagaggagctgaaggggttgtcagcttaaaattcagcagttcagagtggtgtgtg

SEQ ID NO: 193782 - DNA, 2762 bp, Homo sapiens
  Payload ID: 18268
  Gene Name: transmembrane protein 18
  Uniprot ID: Q96B42
  ENST ID: ENST00000281017
  CDS Start-End: 95-517
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataata

SEQ ID NO: 193783 - DNA, 2376 bp, Homo sapiens
  Payload ID: 18268
  Gene Name: transmembrane protein 18
  Uniprot ID: Q96B42
  ENST ID: ENST00000355654
  CDS Start-End: 388-771
gttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttccatcctcctggttccttctccctttcctgtccccatgtttctctgaggcctggcaatgctctctggatacttgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagt

SEQ ID NO: 193784 - DNA, 654 bp, Homo sapiens
  Payload ID: 18268
  Gene Name: transmembrane protein 18
  ENST ID: ENST00000405941
  CDS Start-End: 66-497
ccgtgccgggttcgtctgacagatcccaggggagcccacgccccacgtggccgccaaggggtgacatgggcactcgatggggtctgggcagaaagccgtgctcccctcacctccgtgcctctggtcttctgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagt

SEQ ID NO: 193785 - DNA, 2572 bp, Homo sapiens
  Payload ID: 18268
  Gene Name: transmembrane protein 18
  ENST ID: ENST00000432667
  CDS Start-End: 62-262
ctctgtggattctggccaggccgggttcggcggttgctgtgagagcgggcttcccaacaccatgccgtccgccttctctgtcagctctttccccgtcagcatcccagccgtgctcacggtacagcagggtcccggggagtccaggaggcggcggagtgcggcactgtctggagagttcagtgtattgcagagaggttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttccatcctcctggttccttctccctttcctgtccccatgtttctctgaggcctggcaatgctctctggatacttgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatcatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaa

SEQ ID NO: 193786 - DNA, 623 bp, Homo sapiens
  Payload ID: 18268
  Gene Name: transmembrane protein 18
  ENST ID: ENST00000418447
  CDS Start-End: 15-194
gacatgggcactcgatggggtctgggcagaaagccgtgctcccctcacctccgtgcctctggtcttctggtacagcagggtcccggggagtccaggaggcggcggagtgcggcactgtctggagagttcagtgtattgcagagaggttggagaaaatcaagtcttgcacgtggcgatggctcaagattccctgaggtcttcagtgctgactaaggagtctgaaatgatgattcatgttttacctttggggctgagccaagtgcatctctttgagcaatcgtcttaatttccttgtcgtcaccaattatcataaccaattatcatcgtaaaggatggtaattcctttaattatacccaccttaaaaacatgattctgttccacaaacgaaaggagcacatcagagatgccttcagttctgtgtgcttgaactttgaattccatgaattatagttgcactgaggggagaatcctgtttccatcctcctggttccttctccctttcctgtccccatgtttctctgaggcctggcaatgctctctggatacttgcagacggactggactgagccctggctcatggggctggccaccttccacgcgctctgcgtgctcctcacctgct

SEQ ID NO: 193787 - DNA, 2852 bp, Homo sapiens
  Payload ID: 18269
  Gene Name: transmembrane protein 180
  Uniprot ID: Q14CX5
  ENST ID: ENST00000238936
  CDS Start-End: 238-1791
ggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccccctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgacctggccctctcagcccacgaccgcacccacctcaacttctactgctccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagttttttttggttttttttttaaggatttcatagttttttttttttttttttggagctgttgcccaaaaaaatggatctgttgcagtggtgcaatctgggctcactgaaaccaccacccaggttcaagcaattatcctgcctcagcctcccgagtaggtgggattataggagcgtgccaccatgcccggctactttttgtatttttagtagagacagggtttcatcatgttggccaggctagtctcaaacccctgaccttaggtgatcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcaccctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggacagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcagctgtgcttgaagtggcatgcctcctctgctgcagggctcccccacccccacacggcctctaaagatgtttatttccttatagactgattaaagtcagccattctttttcctcaa

SEQ ID NO: 193788 - DNA, 823 bp, Homo sapiens
  Payload ID: 18269
  Gene Name: transmembrane protein 180
  ENST ID: ENST00000369931
  CDS Start-End: 220-681
gccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccccctcttcggttggctcagtgaccggcagttcctcagctcccagccccgcctgtgtggagaggagctgcttgtaggcagtgaggaggcggacagcatcaccttgggccggtatctccggcagctggcacgccatcggaacttcctgtggttcgtgagcatggacctggtgcaggtgcagtggctcacgcctgtaatcccagcacttcgggacgccaaggtggaaagaccgcttgagcccaggagttcgaggctgcaatgagttatgattgcaccactgcactccagcctgggcggcagagaaaggctccatctctaaaaaaagaagagctaagtgctgtacctaaaacatgcagtatataaactggctgaacttagaaataaactgttttcatgttatgaaa

SEQ ID NO: 193789 - DNA, 5390 bp, Homo sapiens
  Payload ID: 18270
  Gene Name: transmembrane protein 181
  Uniprot ID: Q9P2C4
  ENST ID: ENST00000367090
  CDS Start-End: 12-1850
cgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttgtgaccctttaaactcaaagggaagccttatctgtggctgcttcagggcagtccttcctcgttgagtggccagtgccctgggtaaccaggtggctgaagtgattggtcagttatgtggactgcgttttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagttagaaagtacttaaggggaaaatcgttcttactaagtcatgtattttcaacttgtcttccctggtatatcataaataccgacatattacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattatagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttgccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattc

SEQ ID NO: 193790 - DNA, 3198 bp, Homo sapiens
  Payload ID: 18271
  Gene Name: transmembrane protein 182
  ENST ID: ENST00000409173
  CDS Start-End: 186-746
gagagggggcgggtgctacctggcagctccgcgggtgcgtggccggtgctggctgggagttctggtctcaggcaaggtggggactgggcacatcatcaatacggaatcatggaaaactagaagagtttcaagtgacaggcaaatgtccaattttctgaagaaaaaagacaccttttacctcctccatgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggatggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagcta

SEQ ID NO: 193791 - DNA, 3112 bp, Homo sapiens
  Payload ID: 18271
  Gene Name: transmembrane protein 182
  Uniprot ID: Q6ZP80
  ENST ID: ENST00000409528
  CDS Start-End: 263-664
agagagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggatggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaa

SEQ ID NO: 193792 - DNA, 555 bp, Homo sapiens
  Payload ID: 18271
  Gene Name: transmembrane protein 182
  ENST ID: ENST00000454536
  CDS Start-End: 316-555
agagagagggggcgggtgctacctggcagctccgcgggtgcgtggccggtgctggctgggagttctggtctcaggcaaggtggggactgggcacatcatcaatacgagaagatctttaactcctccaaccatgaagaccttcagaagatgaaattcctgcccaggagagtggatgcccacagagacactggttgtttcatattctgcctactaaagacttatctgtattcaaggaatcatggaaaactagaagagtttcaagtgacaggcaaatgtccaattttctgaagaaaaaagacaccttttacctcctccatgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggg

SEQ ID NO: 193793 - DNA, 3593 bp, Homo sapiens
  Payload ID: 18271
  Gene Name: transmembrane protein 182
  Uniprot ID: Q6ZP80
  ENST ID: ENST00000412401
  CDS Start-End: 206-895
ggcgagcaaagggaatatgaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaatatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggatggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagctatcatctctccatattgtatttgttcagctggtttaattcactcaggtggatgattgcacatacattggaattggctggagagactacacagagaagtttaatgatcgtgtacaatttgagggttgatggtagggctttctaaaaaaagtaatatcaagtgtgttgttagtattcatttagtcatttttattactaatctataaatatatttattaaatttgaagattaaatggaattataaaggaa

SEQ ID NO: 193794 - DNA, 3019 bp, Homo sapiens
  Payload ID: 18272
  Gene Name: transmembrane protein 183A
  Uniprot ID: Q8IXX5
  ENST ID: ENST00000367242
  CDS Start-End: 81-1211
agcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttgtttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggggagaagcacagtccctgccaggttgcctgaactaaagatgccatggagcaggagtgtcttggtgcattgttccccgcttaggagtacctttaaaaagggggtgaaataaatttggcttaataattgta

SEQ ID NO: 193795 - DNA, 6276 bp, Homo sapiens
  Payload ID: 18273
  Gene Name: transmembrane protein 184A
  Uniprot ID: Q6ZMB5
  ENST ID: ENST00000297477
  CDS Start-End: 318-1559
ataggcaggtgagggcgccaggcggccagcaggttcctgggagccagctgccacccagcaaacaaccgggaggatagggtgtcagccgtgggaggggacaggaggggacgggcctgcagcctggggcccaggtgggccactggggacgtgaggcactggccgccccgccccagcctggcacagcccttcagatcctggccttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaatgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagcccccccggcacccatgcagagcatctccagcggcatcagggagacagtgagcccccaggacatcgtgcaggacgccatccacaacttctcccccgcctaccagcactacacgcagcaggccacgcacgaggcgcccaggcccggcacccaccccagcggcggctccggcgggagcaggaagagccggagcctggagaagcggatgctgatcccctcggaggacctgtaggggggcctgggctgccagtgctgtagggacccaggctgcccaggcctctggggaagaacagggtccccccacccaccaactcctgccaaaggtggggcctctcctgagagcccacctgtgaggccctcggagcccacttcccatcctccctccagccagggggtcagggcacctgatggccctggcaggcacccaggtgggcccgccaccgcaggagagggcacctgagccaatcggaagagcctggggaccccctgggatcacccagccatcagccccaggagccactgtggggcggagagtgagtgtggctgcggggccttggctgcacggaccccatgggagctgtgagtgggtcagactccctggttcaggagacagacagcggacggatcccaggctgggcagctggagggaggggcgccggggcgctgggcagccgggctctgacacagtcagcagctccgggcgccgcaggccggcggggtccacacaggctggccggggctgggcctccttggagcctgctacggccctcgtgggcacgtggagaagggcccacgtgtctccacacgccagccacaggggagccctggccaggcgcccagccaggggagcgtgtgcctgggatgggtcacagaaccagcgggcacctgtgaggctggccagcaccgtggggctgtgggaatcgctcttatttatatttaaacaccttggattttctaccgggtcttggcttctgttcccgcagggcatgagcctgaggagcaggacgcggtgggggtcacaggaggctgctgctcagagtctgcatgcgggaaaggggtcccacctgtctggggtgggcagcctcgtggtccagggcagtgcagggcagagcctgggctgtgcgatcacagccactgcctttctcctgggagcctccacttcctccaaaacgggccttgtgccagccccacccgcggcgagcggacaaggccacgaaggcagggccctgagtacctgggcgggggggacactcccagggggcacagagggggctcccacctgggcacctgcctcctgcccttctcttcttcctccacgtgccaggtggggccctgggtttgaggagcctcggacgcgtgccctgcccgcaggaagctggaggcgtgcaagtggcctcggaaatcgcggccgcaagaacagtagccgcccagggactaagggggcttctgggaggacacacggctggcccagggcgaggggtgtcactgcagggcgccccccaggcccagggcccgtcaggggacagtacggtgacccggcctgcaggtggcagtcagttctgtgtgtctggggcccgcagcacaggttgggtgggggctggggcaggggcagcagaagtgggcaaggcctggggggctcaggcactgggcgtggagagcagacaggaagctccagtgggcaccaccccgggaccgcggctcccacccgtgctgccccccacccatggccacggtcaccaggaacagcgggacctggggtctccgagggactcagcagggcgggcacagaccagtggagtccgggctagagagggccagctcccagcctcttgcttcctgggctgaggacatggggatccaaggccagtgggtctgcagggcccagcccggctgcctgataagataggctgagctcctccctgcacggctgcaaagacgcccacctgtcttattggatccccacaggaatagacccaccaggcggcccccgtgtctcactctgtcagcaggtccccagggacctgctgccgaggggcagtttctggaggctgggggcactggctgggctctaggcctgctctgcccttgccgtggggaaggccaccccgataggggtcaagttgctcaaatctgcgtttggagggtgtgtggccgagggctccctttctggagacccagacaccgcctgggctccgggcggcagaggctgaggtgtcaggggctgagcccctatgtcagcaacacctcaggcctgcactttaggacaggggagaagtcagtttccgccaaatgccccctcagaccagccgaggactgtgccaggaaactgacatgctcaacgctcaagccagctgggacagcgaccgagcccagagagacggagcaagttgcctgaggtcacagagcagggacttggacaccaggcagccggctccacagaggccctctctcctccctgcctcctgaccctcagacgcctccgccccacgggtgaggctgcttctgcttctttccaacacgactcgaaggaaagccctgagggccgagcccgctctgcgtggacggaaggcagcgtggggcggtccaggccggggctcaacctgcctcgagggggagcgtgggcgcatgtgagcgggagggacggagactagcgtggttccagtgtcgtcatcgctgctaaaaaaggggtttcccggtgacaggccccgacagaggagcaggccatgaggcaggcaggagccgcgtatctgggcccagcgcacccgccaagctctctagcctctcctggcctcagtatccttctctgggagatggtccagctgaaaatccccagcatccacaagaaacggtggaagccctgggggccctggcctggcccgggtgcaggctgcatggccgggcggggcggtgtctcctttcacagcttccccgtctgtccgcagcctccaggagccccacacagggctggggctctgtgcccccaactcacacccgtcggctcccccaggaggagcaggctgggcccagagccgcagggtgggctgcagggaggtctgacttagctggggaaagtgccatccctgccattgctagtgacaagctcgggctgctgtggccccagcacagattcaacactcactgcgctatgtgccagctgttgcacactcacctccacacccaactcacaggaagcaaggctgggaaggagggaactggccccaggccacacagatgctgcgagttgggattatgatcgggtgcagtggctcacacctgtaattccagcacttggggaggccaaggcgagtggattgcttgagcccaggagtctgagaccagcctgggcaacatggtgaaaccccatctctacaaaaaaaaaatacaaaaattagctgggcgtggtggtgcgtgccggcggtcccagctactcaggaggctgagatgggaggattgcttgagcctgggaggtcgaggctgcagtgaactgtgatcacgcccctgcactccagcttgggtgacaaagcaagatactgtctcaaaaaactcgagttgggatttcaccctgcgtggtccagcactgaacagcgttcacacctcggtcagctcagccccaaaaacggggaaggccgggcggggtggggacggcatgcgggcaggcccgtggcttttcggaggagtccacgggcttccggccactgtgcaggggcgctttgctctctgctcccagacagaccctgtcttgctcacagcttcctgcaggctcctctgagagtccagcaaagctgggcgagatgtctcccagggaaggggaacactgacagccgtgctgctctctgctccttccactggaagggagaggctgcatggacagggggctccgggtggggcagatggggacactcaggactgcggcctgaccctcagagactgagcccaggacgtggtcacctgaccagcacctcccccgtggctgtcccagcctcacggtcacggcccagcagtccgggaaagccacttacacgtagtgcccggatcctgaccccggtgagggacaggcagggtcccctgggattggggggggggtgtggttcttggcccaagaaagccccagctgaaagcaccagctacgcaacgaaagggtctgaaaccagaaaattctttattgcaaaggtacaaaagcagtcacagcagcaggacgcacggcaataaattaggtggtggccgcagggacggggcagggcggcggcggccagacacgggcccacatgtgatctgttttcaataatttatatcatgataaaaagcagcacaaaaaataaataatgaaatggaactgccaagtagcacagaagccagggtgaggcggtgtggcggcgtggcggcatagggggccggggtccccacgccctggaaacgcaaagacctggatctctttgggaagccggaggcacggagacagaaaacaaacccacgtgacaaagagtccctcgtctttttcttaaataaaaaaatccatatattaaatcatgacaatgaaatttcaacaatctgaaaagaaaagcagaacacaccgtgcttccccggcccagctctgggcggtgacagcggctccgtccaccctggggaccagggagtcccttctccagcaaagcactgcaggccaagggcaggtagaagcccacggcccacaagacgtggacaccaagaaccccaagacgggacagaaccggccacccgctgcggcctgtcctgcggggcccagctgcctggtacagtccgtggggagatgaagggggacggcgggcagcccgggcctccgctttgctcccaactcccacctgtgcccgtgcccccggctctgctctgatagatttacagtatcaaactggaaaagaaagattgttacgaaaaatctgtagataaactgtgaatataattttatatctcta

SEQ ID NO: 193796 - DNA, 866 bp, Homo sapiens
  Payload ID: 18273
  Gene Name: transmembrane protein 184A
  ENST ID: ENST00000319010
  CDS Start-End: 125-866
cctggccttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaagacctcggtgcctgccaaggccgggggcctggacctcccctcacaggacacggctgggtgtccgcagcggctacctctatgtgaccctcatctacaac

SEQ ID NO: 193797 - DNA, 4374 bp, Homo sapiens
  Payload ID: 18273
  Gene Name: transmembrane protein 184A
  ENST ID: ENST00000319018
  CDS Start-End: 71-571
gaatgaccagctaggcttccctggaggccaggcctccctggactgggccaggtgcttcctgccagcaaagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagccactctgcagttctgcctggtgaagcccgtcatggccgtcaccaccatcatcctccaggcatttggcaaataccacgacggggacttcaatgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagcccccccggcacccatgcagagcatctccagcggcatcagggagacagtgagcccccaggacatcgtgcaggacgccatccacaacttctcccccgcctaccagcactacacgcagcaggccacgcacgaggcgcccaggcccggcacccaccccagcggcggctccggcgggagcaggaagagccggagcctggagaagcggatgctgatcccctcggaggacctgtaggggggcctgggctgccagtgctgtagggacccaggctgcccaggcctctggggaagaacagggtccccccacccaccaactcctgccaaaggtggggcctctcctgagagcccacctgtgaggccctcggagcccacttcccatcctccctccagccagggggtcagggcacctgatggccctggcaggcacccaggtgggcccgccaccgcaggagagggcacctgagccaatcggaagagcctggggaccccctgggatcacccagccatcagccccaggagccactgtggggcggagagtgagtgtggctgcggggccttggctgcacggaccccatgggagctgtgagtgggtcagactccctggttcaggagacagacagcggacggatcccaggctgggcagctggagggaggggcgccggggcgctgggcagccgggctctgacacagtcagcagctccgggcgccgcaggccggcggggtccacacaggctggccggggctgggcctccttggagcctgctacggccctcgtgggcacgtggagaagggcccacgtgtctccacacgccagccacaggggagccctggccaggcgcccagccaggggagcgtgtgcctgggatgggtcacagaaccagcgggcacctgtgaggctggccagcaccgtggggctgtgggaatcgctcttatttatatttaaacaccttggattttctaccgggtcttggcttctgttcccgcagggcatgagcctgaggagcaggacgcggtgggggtcacaggaggctgctgctcagagtctgcatgcgggaaaggggtcccacctgtctggggtgggcagcctcgtggtccagggcagtgcagggcagagcctgggctgtgcgatcacagccactgcctttctcctgggagcctccacttcctccaaaacgggccttgtgccagccccacccgcggcgagcggacaaggccacgaaggcagggccctgagtacctgggcgggggggacactcccagggggcacagagggggctcccacctgggcacctgcctcctgcccttctcttcttcctccacgtgccaggtggggccctgggtttgaggagcctcggacgcgtgccctgcccgcaggaagctggaggcgtgcaagtggcctcggaaatcgcggccgcaagaacagtagccgcccagggactaagggggcttctgggaggacacacggctggcccagggcgaggggtgtcactgcagggcgccccccaggcccagggcccgtcaggggacagtacggtgacccggcctgcaggtggcagtcagttctgtgtgtctggggcccgcagcacaggttgggtgggggctggggcaggggcagcagaagtgggcaaggcctggggggctcaggcactgggcgtggagagcagacaggaagctccagtgggcaccaccccgggaccgcggctcccacccgtgctgccccccacccatggccacggtcaccaggaacagcgggacctggggtctccgagggactcagcagggcgggcacagaccagtggagtccgggctagagagggccagctcccagcctcttgcttcctgggctgaggacatggggatccaaggccagtgggtctgcagggcccagcccggctgcctgataagataggctgagctcctccctgcacggctgcaaagacgcccacctgtcttattggatccccacaggaatagacccaccaggcggcccccgtgtctcactctgtcagcaggtccccagggacctgctgccgaggggcagtttctggaggctgggggcactggctgggctctaggcctgctctgcccttgccgtggggaaggccaccccgataggggtcaagttgctcaaatctgcgtttggagggtgtgtggccgagggctccctttctggagacccagacaccgcctgggctccgggcggcagaggctgaggtgtcaggggctgagcccctatgtcagcaacacctcaggcctgcactttaggacaggggagaagtcagtttccgccaaatgccccctcagaccagccgaggactgtgccaggaaactgacatgctcaacgctcaagccagctgggacagcgaccgagcccagagagacggagcaagttgcctgaggtcacagagcagggacttggacaccaggcagccggctccacagaggccctctctcctccctgcctcctgaccctcagacgcctccgccccacgggtgaggctgcttctgcttctttccaacacgactcgaaggaaagccctgagggccgagcccgctctgcgtggacggaaggcagcgtggggcggtccaggccggggctcaacctgcctcgagggggagcgtgggcgcatgtgagcgggagggacggagactagcgtggttccagtgtcgtcatcgctgctaaaaaaggggtttcccggtgacaggccccgacagaggagcaggccatgaggcaggcaggagccgcgtatctgggcccagcgcacccgccaagctctctagcctctcctggcctcagtatccttctctgggagatggtccagctgaaaatccccagcatccacaagaaacggtggaagccctgggggccctggcctggcccgggtgcaggctgcatggccgggcggggcggtgtctcctttcacagcttccccgtctgtccgcagcctccaggagccccacacagggctggggctctgtgcccccaactcacacccgtcggctcccccaggaggagcaggctgggcccagagccgcagggtgggctgcagggaggtctgacttagctggggaaagtgccatccctgccattgctagtgacaagctcgggctgctgtggccccagcacagattcaacactcactgcgctatgtgccagctgttgcacactcacctccacacccaactcacaggaagcaaggctgggaaggagggaactggccccaggccacacagatgctgcgagttgggattatgatcgggtgcagtggctcacacctgtaattccagcacttggggaggccaaggcgagtggattgcttgagcccaggagtctgagaccagcctgggcaacatggtgaaaccccatctctac

SEQ ID NO: 193798 - DNA, 640 bp, Homo sapiens
  Payload ID: 18273
  Gene Name: transmembrane protein 184A
  ENST ID: ENST00000441933
  CDS Start-End: 165-640
agcaaaggtagagctgggccctgtgaccgcagaccagagggagaggaggaggctggactgggctgcgagtgtgggagagggtggactcagggccccagcaggttagtgggagatggaacaggcacccagggctgccaagaaccccagcaaagccgggctcccagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaa

SEQ ID NO: 193799 - DNA, 574 bp, Homo sapiens
  Payload ID: 18273
  Gene Name: transmembrane protein 184A
  ENST ID: ENST00000414730
  CDS Start-End: 48-574
acctttgccctcactcctcccggtgtgtgtcctccctccctctgcagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccat

SEQ ID NO: 193800 - DNA, 579 bp, Homo sapiens
  Payload ID: 18273
  Gene Name: transmembrane protein 184A
  ENST ID: ENST00000431208
  CDS Start-End: 161-579
aatcatctctcagggacccaggctgcccgccgctgtgaggaggcggcagcagaggccaggaggccgggggccgagcttcaggcccaccccgccttggcccccccctcaggcccagagacctgcagccaacctgcctgacaggctgagcgccaccagggagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgttt

SEQ ID NO: 193801 - DNA, 744 bp, Homo sapiens
  Payload ID: 18273
  Gene Name: transmembrane protein 184A
  ENST ID: ENST00000421923
  CDS Start-End: 161-553
aatcatctctcagggacccaggctgcccgccgctgtgaggaggcggcagcagaggccaggaggccgggggccgagcttcaggcccaccccgccttggcccccccctcaggcccagagacctgcagccaacctgcctgacaggctgagcgccaccagggagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccacc

SEQ ID NO: 193802 - DNA, 3593 bp, Homo sapiens
  Payload ID: 18274
  Gene Name: transmembrane protein 184B
  Uniprot ID: Q9Y519
  ENST ID: ENST00000361684
  CDS Start-End: 225-1448
gggtgtgcccgctccctttccacgccaacgtggcgggggcagctcctggagtgtaatcggacctgtccggggggcggccccgggagagggaggcggatggaccaaggcgctttgcaagagggattgtgtgctcccgggtgggtgtgctggcgactggcacggccgagctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 193803 - DNA, 3611 bp, Homo sapiens
  Payload ID: 18274
  Gene Name: transmembrane protein 184B
  Uniprot ID: Q9Y519
  ENST ID: ENST00000361906
  CDS Start-End: 210-1433
agagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaatctc

SEQ ID NO: 193804 - DNA, 555 bp, Homo sapiens
  Payload ID: 18274
  Gene Name: transmembrane protein 184B
  ENST ID: ENST00000411679
  CDS Start-End: 114-332
gagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagcccagggctcggctgggccaagtgtgatgtcatgagagctgggacgagacacccaggggctgcctggactgaggactgtgatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggcctt

SEQ ID NO: 193805 - DNA, 555 bp, Homo sapiens
  Payload ID: 18274
  Gene Name: transmembrane protein 184B
  ENST ID: ENST00000457534
  CDS Start-End: 181-408
actgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagaatcccagcatctgcggacccattctgctgatttgactggtttctcctggacactctcttcgcagccttggtcatctataatttcctgagcctgtgctatgagtacctaggaggagaaagttccatcatgtcggagatcagaggaaaacccattgagtccagctgtatgtatggcacctgctg

SEQ ID NO: 193806 - DNA, 3667 bp, Homo sapiens
  Payload ID: 18274
  Gene Name: transmembrane protein 184B
  ENST ID: ENST00000436674
  CDS Start-End: 186-404
actccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagcccagggctcggctgggccaagtgtgatgtcatgagagctgggacgagacacccaggggctgcctggactgaggactgtggtagagcagctcttggcatttatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataa

SEQ ID NO: 193807 - DNA, 1369 bp, Homo sapiens
  Payload ID: 18274
  Gene Name: transmembrane protein 184B
  ENST ID: ENST00000633438
  CDS Start-End: 1-1045
gcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaagtgccaacatacggcccttacggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtg

SEQ ID NO: 193808 - DNA, 4178 bp, Homo sapiens
  Payload ID: 18275
  Gene Name: transmembrane protein 184C
  Uniprot ID: Q9NVA4
  ENST ID: ENST00000296582
  CDS Start-End: 575-1891
gagctgaaagtcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggacttttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccatagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaatgaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatat

SEQ ID NO: 193809 - DNA, 774 bp, Homo sapiens
  Payload ID: 18275
  Gene Name: transmembrane protein 184C
  ENST ID: ENST00000505999
  CDS Start-End: 1-219
cttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttgcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaa

SEQ ID NO: 193810 - DNA, 1528 bp, Homo sapiens
  Payload ID: 18275
  Gene Name: transmembrane protein 184C
  ENST ID: ENST00000508208
  CDS Start-End: 572-1357
ctgaaagtcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggccttaaccccgaaactgactatactggagaaggaaaggccgtgtaaagacacaacaagaaagcagaatctgcaatccaggaagagaatcctcacaagaaaccaaacttgccaacaccttgatcatggtcttccagcctccagaactgtgagaaaataaatgcctattgttaaagcta

SEQ ID NO: 193811 - DNA, 903 bp, Homo sapiens
  Payload ID: 18276
  Gene Name: transmembrane protein 185A
  ENST ID: ENST00000507237
  CDS Start-End: 119-640
cgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgtatgtaacttttaaaatccttaaataaagttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaaca

SEQ ID NO: 193812 - DNA, 717 bp, Homo sapiens
  Payload ID: 18276
  Gene Name: transmembrane protein 185A
  ENST ID: ENST00000502858
  CDS Start-End: 1-671
tggtctgtgacagaatcgagagaggaagccatttctggctcctggtcttcatgccgctgttctttgtttccccggtgtctgttgcagcttgcgtttggggctttcgacatgacaggtcactagaggttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctc

SEQ ID NO: 193813 - DNA, 283 bp, Homo sapiens
  Payload ID: 18276
  Gene Name: transmembrane protein 185A
  ENST ID: ENST00000511776
  CDS Start-End: 103-283
gacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgt

SEQ ID NO: 193814 - DNA, 684 bp, Homo sapiens
  Payload ID: 18276
  Gene Name: transmembrane protein 185A
  ENST ID: ENST00000502900
  CDS Start-End: 141-380
gcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggcattcctgcccttggaagaaacaacataccaggagctgagctccctcctcctgtgatgcaagaacagtacctatgttggtgcctttaggagagccgagtggcctatgcacagctgggtctgctat

SEQ ID NO: 193815 - DNA, 436 bp, Homo sapiens
  Payload ID: 18276
  Gene Name: transmembrane protein 185A
  ENST ID: ENST00000502618
  CDS Start-End: 1-181
taaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttg

SEQ ID NO: 193816 - DNA, 2840 bp, Homo sapiens
  Payload ID: 18276
  Gene Name: transmembrane protein 185A
  Uniprot ID: Q8NFB2
  ENST ID: ENST00000600449
  CDS Start-End: 333-1385
ccggtcgcgtgcggacacaaggatggggacctcccagcgaggagcgctctgggcggggctccggacgcatgcgcggccctcgtacggaagcccggaaggaggggcagggggcggtggctcaggtttctccgggcggcggcggcggcggcggcggcggcggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttta

SEQ ID NO: 193817 - DNA, 1913 bp, Homo sapiens
  Payload ID: 18276
  Gene Name: transmembrane protein 185A
  ENST ID: ENST00000613273
  CDS Start-End: 19-537
gtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 193818 - DNA, 2178 bp, Homo sapiens
  Payload ID: 18276
  Gene Name: transmembrane protein 185A
  ENST ID: ENST00000612022
  CDS Start-End: 140-277
cagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttta

SEQ ID NO: 193819 - DNA, 2662 bp, Homo sapiens
  Payload ID: 18276
  Gene Name: transmembrane protein 185A
  ENST ID: ENST00000611119
  CDS Start-End: 333-1208
ccggtcgcgtgcggacacaaggatggggacctcccagcgaggagcgctctgggcggggctccggacgcatgcgcggccctcgtacggaagcccggaaggaggggcagggggcggtggctcaggtttctccgggcggcggcggcggcggcggcggcggcggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgttgtgtgtgtcccgctgtggattctcatgtcctttctgtgcctggtggtcctctactacattgtgtggtccgtcttgttcttgcgctctatggatgtgattgcggagcagcgcaggacacacataaccatggccctgagctggatgaccatcgtcgtgccccttcttacatttgagattctgctggttcacaaactggatggccacaacgccttctcctgcatcccgatctttgtccccctttggctctcgttgatcacgctgatggcaaccacatttggacagaagggaggaaaccactggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccacaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcatttt

SEQ ID NO: 193820 - DNA, 2131 bp, Homo sapiens
  Payload ID: 18277
  Gene Name: transmembrane protein 185B
  Uniprot ID: Q9H7F4
  ENST ID: ENST00000426077
  CDS Start-End: 433-1485
gtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtgatgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttagg

SEQ ID NO: 193821 - DNA, 1448 bp, Homo sapiens
  Payload ID: 18278
  Gene Name: transmembrane protein 186
  Uniprot ID: Q96B77
  ENST ID: ENST00000333050
  CDS Start-End: 35-676
gtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggcccctgggaacatgtgttttgtggtgaataaattcacaaggcaagagctggtgtacaggtttaggaaaaaggctctaagcaagttcttacagcacttgtttgtgacattcagtcagataatggccagaagtttttgttaagagccagttcttagaagaacctatgccaaggtcacccatagagtccattggtgtgaaagagaaaggcaaagaggtgtggcgggggagcgtaagatttggagtcagaagtctcagttctgtcatttgtcctggagcaggttattgagtctctttgaatcttggttttcacatctgtaaaatggaaagtcctgcttgtttcatgggatgggtgtgggaataaacaataaatgtcaaacgtgtggcagactcaacagcctacagcagatattattaagcatttggtcagaggttttagcagggagaaaggcttcgagcagtcagcagggacttccagagccctgtgctgtgcccctcacatatccagcggcagaagggtctgtcaggatgttaactacacattgacgagcagatgtcgtccaggtaggcacgaaaccccagttgagatttgttcaccacccagaggtctagaggctcttgctttggatggccctgcagtgtaataaagccaaatgcaccgga

SEQ ID NO: 193822 - DNA, 1880 bp, Homo sapiens
  Payload ID: 18279
  Gene Name: transmembrane protein 187
  Uniprot ID: Q14656
  ENST ID: ENST00000369982
  CDS Start-End: 748-1533
ccggggttggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggtggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagagag

SEQ ID NO: 193823 - DNA, 440 bp, Homo sapiens
  Payload ID: 18279
  Gene Name: transmembrane protein 187
  ENST ID: ENST00000425274
  CDS Start-End: 243-440
actgtaagtgctcaccgcagccctgggaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctg

SEQ ID NO: 193824 - DNA, 330 bp, Homo sapiens
  Payload ID: 18279
  Gene Name: transmembrane protein 187
  ENST ID: ENST00000431598
  CDS Start-End: 232-330
taagcgattaggtcaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtg

SEQ ID NO: 193825 - DNA, 2222 bp, Homo sapiens
  Payload ID: 18280
  Gene Name: transmembrane protein 189
  Uniprot ID: A5PLL7
  ENST ID: ENST00000371650
  CDS Start-End: 98-901
gctgggcggtcattgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacag

SEQ ID NO: 193826 - DNA, 7714 bp, Homo sapiens
  Payload ID: 18280
  Gene Name: transmembrane protein 189
  Uniprot ID: A5PLL7
  ENST ID: ENST00000371652
  CDS Start-End: 98-910
gctgggcggtcattgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacaggacagaaccacagcggaaaagcagggtcggtgctgctttggcagggtggtcatgaagggcctctgagctgagacctgggggaggagaggaggtcagacacgaaagaagtgagggaagaggcctcttgatgggacagcaagtacacaggccctgaggcaagaacaagcttggggccacgcacagtggctcacgccagtaatcccagcactttgggaggctgaggcggacagatcacctgaggtcaggagttctagaccagcctggccaacatggtgaaaccctgtctctactaaaatttacaaaaattagccaggcgtggtggcagacgactttatcccagctacttgggaggcagaggcaggagaatcatttgaacccgggaggtgaaggttgcagtgagccgagatcgagccattgcactcaaacctgggggataagagcgagacttcgcttagaaaaaaaaaaaaagaacaagcttgggattttaagagatggtgaggcagccactgtggctggactagagtgagctaaggaaaaatggaagacaaggttgggaaaacatggatttggtatacagagactcataggctgaggtgagtggggacctgctggtcattttatttatttgtatttattactatgtttttagagacagggtcatgctctgtcacccaggctaaagtgcagaggtgaggtgtaatagctcacagcaaccttgaactcctggacacaaacgatcctcatgagtggctgggactagcacatgccgccacacctggcttggctatttttttttttttttaaagaaatggggtctcactatgttgtccaggttggtcttgaactcctggcctcaagtgatccgccttggccttccaaagtgctggaattttaggtatgagccactgcaccgggtcaggacattatagaccaattagtaacttgtttatttgttgaataagtaattataaggcatctcctatgaactaggtactgcgattctgtagtgaacgctacagacatagtcaatagctagtctaggctagatagtttctgcaatattagccagaaaaaagaaagcctgttggggacagggaaatgcctaaaggactccagagcagtcacagataatgacatttctgagtagctgggattacaggcgcccaccaccatgcccggctaattttcgtatttttagtagagatggggtttcagcatgttggccaggctggtctccaactcttgacttcaggtgatccacccaccttggcctcccaaagtgttgggattacaggcatgagccactgcgtccagccatgacatttattttttaaaacgtgacccataatgccattttcctttgccaactagacttttgatttgtgactatgcctgaggggaccacacaaggaagggtgttagaattcgacaactcataaatgacagaaatttaaagtaaacagctaaaataatcgtattagctcataaaacggaaaagtctacaggtgttctgaattaaggtttggcaggacccaggggctcacatgattcatcaaaacgtggtctctctaagctctgtttttctctttgagttgagacttactagaccagctcagcaatctcagtggaaagtgcattcccagtagttgcagtggaagtcccagggcaggctctcattggtctggactgggtcacgtgcccatccctgaaccaatcacattggccagtggggtgaaatgctctggttgcccagggctgaaaaatgtccatctggatttgcagggttgtgatcacctcttcctaaggcattactacaaaaagaagtcaatggtggatgggacaggcagctaaattctttagaggccataggagtagcctcaccactgtggtgttggtttccaggccccaccaatctgtgtcagttcccctggagccgacagaaaaaaaaccctcagcctgagtccagagaggtaaagtgactcccccaaggtcccacaggtagtaagggtagagcagccctcagactcagaccatttcacttctgaattctgggggctggaaaaaaatccttctcaaaaccagaaggtgcgctgcattgggtctgagagtgttggggccacttgtgagatcagggacttgcaaacaagtgcctatgagggccagacaggggaaaatgctacttaatattactgagcacttaactttgcaccagactgtgcagagagctctggcatgggtcctgtcaagcagtccctgcagctctgagaagtgagtactctttgcaccatttgcagatggggaaactgaggcacagaggtcatgtaatatgcccaaggtcacacagctggtaggtggcagaatcaggatttgagccagcgtctgacccaaagcccctgtgctttaacgctcccattgtggagagggaggtgagacaggtggcacgtgagaaatgtgtccactatgaggcaactgcagcatgcctgagaaagggccgctgacgctggggactgggatgacctggagacatcaggcctaaagggcagctgctactcacagcagctggttaaacaggagccagaaatctaaactttaaaaatgctggctccgtgtttaaaacgtactgtgggcaaaacaaaatgagtgcataggccaactgcctgcagcctccctcccagctgctgtgggatggcttggtttcaggtaggcatgtgctgctgtctggtggtggcacagggtagtggcatgcagggcaaacatggatttccagctcaaccgggggagctgtagtgaacttgcatacccctgtgtgctcactgttctttagaaggggcctgggcacatacctttgggcgcctgcccccaactgaaactccatcaccccgccttttttttttcctggagacggggtcttgctctgtcacccaggctggaacacagtggcatgatctgcgctcactgcagactcaacctcccaggctcaagcaatcctcccatttcagcctcttgaatagcgggaacgacagacatgtgccaccacccccagctagtttctttttgtattttttgtagagatggggtttcaccatgttgcccaggctggtctcgaacgcctgagctcaagcgatcggcccacctcagccttcctaagtgttgggattacaggcatgaaccaccgcgcccagccaaccctcctttgataaaccaaaaatatttttcaagctacccacatatatatatgggtatatatatatatatagcaatatatatattgctatataagcaataggtaatgcttgcataggtaaagaataagaatcacgccgggtacagtggctcatatcaaataatataaacagggctagagtatggataagctgaccctggacagtgggccaaatccagccacttgcttttctatagctcagaagcttttgtgggttgtttgtttgtttgtttgtttgtttgttttttagagacagggtcttgctctgttgtccaggctggagtgcagtggcacaatcacagctcactgtaacctcagactcctgggctcaagtgatcctcccacctcagcctcctgagtagctaggactacagatggacaccaccacatccagctaatttttttttttttttagagatggggtctcgctatgttgcccagggtagtctcaaactcctggcctcaagtgatcctcccacctcaacctcctgaagcactgggattacaggtgtgagccaccatgtcagccacgagcattttttaaatggctgggggagggggaacaatatttcctaacacagaaaattcaaattccagtttgtaaagctgaattggcacacagccatgcccctcatttacatattgtccgaggctgcttttgcactgcagtggcagaattgagtcgttgcatcggagaccacgtggtccacacagcctaaaatatttacgatctggccctttacagagaaaagttaccaacctctccctagtctagaatgaagggtaaattgctccccattcatgttccctcaggtactcagttcccctccttagaggccatcattttgacaagacacttgcaatgccttatgtaggcagaggggtatgtctgccccactccttttcacacaatatgtaggatattatgcacacagttctgcaccttgccttttttcacttaatatattttggagatagtgttatcattaatgttcacaaaccattattattttttacagctgcatagtgttccaccttcaggatggaatggacttgacttttttttttttttttttttgagacaaagtcttgctctattacctgggctagagtgcagtggtgcaatcccagctcactacagcctctgcctcctgggctcaagctatcctctctcagcctcccatcccaagtagttgggactacaggtgcatgccaccatgctgagctaatttttttttattatttttagagacgggggtcttgctttgttgcccagactcgtctcaaactcctgtgctcaagcaatcctcctgcctcagactcccaaactgctgggattacaggcttgaaccacgagtgtgttttaaattttgatagtgcataccaaattgtcttccagaggccatgccggtttaagttcacaagttttcagagtccctgtttcctcacacccttgccaacacagcgtgttatcaaatgttttgttctttgccaatctgataggtggttttaatttgcattcctcttactgtatttcattgattctaagatgtcactgattctaagatgcatcctgatttcagaagttcacatgtaaaaatgtggctgggtgtggtagctcacgcctgtaatcccagcactttgggcggatcacgaggtcaggaattcaagaccagcctggccaacatagtgaaaccccgtctctaccaaaaatacaaaagaaataattagctgggtgtggtggcgggtgcctgtaatcccagctacttgggaggctgaggcaggagaattgcttgaacccaggaggcggaggttgcagtgaactgagatcgcgccactgaactccagcctgggcgacacagcgagactctgtctcaaaaaaaaaacaaaaaaaaagtaaaaacgtatagcttcaaatcactgaaatacaatatgttttgtgagattgggtatcttactgtgagtttaaaatgcatttgcatttcctcatctgttcatgtccttttcctatttttcttggaagggagggtagcattggttaagagtgtagggttcaaatcccagttctgccacttacaagcttgtgactttgggcaagttacttaaccgttctgtgtctcagtttcctcacctgcaaaatgggaataataatggtacctacctcataggataggtgtgaagattaaatacattattatatgcaaaataccatgttcctggaatatggcaaatgctcaataaatatttgctgtaactgtca

SEQ ID NO: 193827 - DNA, 1973 bp, Homo sapiens
  Payload ID: 18280
  Gene Name: transmembrane protein 189
  ENST ID: ENST00000371656
  CDS Start-End: 98-685
caagtaacaggcaggaggagtgttaagcctgaggctccatcttcagggaagaaaacatcccaactagagaagaagggacaccttcccctcctaacaaatgaatgagcgggcaattgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaa

SEQ ID NO: 193828 - DNA, 813 bp, Homo sapiens
  Payload ID: 18280
  Gene Name: transmembrane protein 189
  ENST ID: ENST00000371658
  CDS Start-End: 4-279
gccatggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccc

SEQ ID NO: 193829 - DNA, 2028 bp, Homo sapiens
  Payload ID: 18280
  Gene Name: transmembrane protein 189
  ENST ID: ENST00000453505
  CDS Start-End: 98-235
gctgggcggtcattgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccagtgcccttcactctctgaagaacagccatgcctgaatcagagtctgcagacagcctggtgccccaaatctgcaatcaaggccctttatctcctccagacctggaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctg

SEQ ID NO: 193830 - DNA, 5656 bp, Homo sapiens
  Payload ID: 18281
  Gene Name: transmembrane protein 19
  Uniprot ID: Q96HH6
  ENST ID: ENST00000266673
  CDS Start-End: 595-1605
cacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccaagtagctgggatcacaggcgtgcaccatcacgcccggctaatttttgtattttcagtagagacagggtttcgccacgttggctaggctggtctcgaactcctgacctcaagtgatctgcccatctcagcctcccaaagatctattacaagatgtgagccactgtgcccagccaccagggcatgtttttaaaaaagtactgatgtctgggtttcacactgcaaaattctgatttatctgatctaaggtacagcctggatattgagactttttaaagctctgactgtacattgaatcatcatgtaaggagtttttaaaacattgttgccagggcccctttctagaccaagttagtcagaatgttggacaatgaggcccatgcatgggtatttttacaaagctctctgggagattctaatgcttaaccaaattgagaagcactgaataagaatatcctgggccgggcgcactggctcatgcctgtaatcccagcattttggaaggccgaggcgggtggatcacttgaggtcaggagttcgagaccagcctggccaacatggtgaaacaccgtctctactaaaaatacaaaaaattaggtgtggtggtgcgtgcctgtattcccagccactcaggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaagaatattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagcataaaggtgtactgtttcttatcatactgttccatgatagaagagagcagatatatgtggcttggggcagctcctgaagaagacttgcaggagtagcatgttgaaaactcattaaatggagccaccaagagaccaaagaattgatacagcaggtcattctattattagcttttctcattacttgagttatctgtttctcacatatatctttcctgtttctagctgctgtacacataggatgctgcctgcagaaatagcagccccgccccaattagataaaggactagtatagagaaaaagcatgtgaaatgatgttttaaactttgccgcatacctgtgatatgaacagctgctgcctgttaggcacagtgggtatactagggcccaatcatctgatcttcctgaagttttatgtaatgttcccagtgctatcacaatgagaatgatctatactagccaccagatctcaggtgaattgtggtgtgctttaaaaatgaaaacacagccggacgaggtggcttatgcctgtaatcctaacactttgggaggccgaggcgggcagatcacgaggtcaggagttcaagaccagcccggccaacacagtgaaaccccatctcttagccgggcatggtggcgcatgcctgtagtcccagctattcaggaggctgaggcgtgagaatcacttgaacccaggaggcagaggtttcagtaagcagagagcgtgccaccgcactccagcctgggtgacagagcaagactccatcttgaaaaaaaaaggaaaacacaattatgtggcttaattatttaatctcctttatggagtatctgtttttataactccaagtggttcttgatattttaaaaatacttaagcattcaatatgtattcattgaattaagttgtttgactctaatcattgtttcttttaagaatgactggaaggtgataatcagcaccatattcctggaggaaaatacaaaatgaaaaacc

SEQ ID NO: 193831 - DNA, 567 bp, Homo sapiens
  Payload ID: 18281
  Gene Name: transmembrane protein 19
  ENST ID: ENST00000550787
  CDS Start-End: 1-457
agacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactgaatgggcagttcatgttaaaatcacttttcatggaaagagctctatgtaacagcataataaaactgcctacctagcagca

SEQ ID NO: 193832 - DNA, 661 bp, Homo sapiens
  Payload ID: 18281
  Gene Name: transmembrane protein 19
  ENST ID: ENST00000546677
  CDS Start-End: 233-661
tgttttctgttgttgttcctgttctgatcgtctctaatggccttaaaaagaaaagtctagatcacagtggggctctaggagagacagggtttcgccatgttgaccaggccggtctcgagctcctggtctcaagtgatcacctgcctgggcctcccaaagtgctgggattacagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgattttt

SEQ ID NO: 193833 - DNA, 739 bp, Homo sapiens
  Payload ID: 18281
  Gene Name: transmembrane protein 19
  ENST ID: ENST00000550524
  CDS Start-End: 229-739
ggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcct

SEQ ID NO: 193834 - DNA, 1772 bp, Homo sapiens
  Payload ID: 18281
  Gene Name: transmembrane protein 19
  Uniprot ID: Q96HH6
  ENST ID: ENST00000549735
  CDS Start-End: 186-1082
agctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactggtaagaacattccttcattcttgcaacttattggtatgttaaagaaatagggaaaagaaagaaaaaaatgttaacaatgaaaacaaatccaaagacacagggtgttgagggactagaaatgatagggcaaagtctctttcacaattttggttttcttattcttttgtattaaattaattgaaagagaattagtcccgcgcagcaatgattagaagccatgtggggaagatacaatagtgcagagaacagacgtttttgtgtgagccattacctaatcccagaaaagcaagacgtttgggatcagatcattttaatacaattccttccattcattttcctattccatttgaggagtaattgtacaaatctgactatacacacgacctactttcttactgtggtatcatgcttgctattcttgcccctgagttttttgcttcattaagatatatggtcgatgtctgggcacggtggctcacatctataatcccagcactttgggaggccaaggggggcagatcactggaggtcaggagttcgagactagcctggccaacatggtgaaaccccatctctactaaaaatacaaaaattatctggtgtagtggcgcctgcctataatcccagctacttgggaggctgaggcaggagaattgcatgaacctgggaggcggagattgcagtgagccgagatcatgccactgcactatagcctgggcaacagagcaagactccatctc

SEQ ID NO: 193835 - DNA, 506 bp, Homo sapiens
  Payload ID: 18281
  Gene Name: transmembrane protein 19
  ENST ID: ENST00000546795
  CDS Start-End: 1-501
ggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataagaatgggcagttcatgttaaaatcacttttcatggaaagagctctatgtaacagcataataaaactgcctacctagcagca

SEQ ID NO: 193836 - DNA, 593 bp, Homo sapiens
  Payload ID: 18282
  Gene Name: transmembrane protein 190
  Uniprot ID: Q8WZ59
  ENST ID: ENST00000291934
  CDS Start-End: 19-552
ggggtctggggaggtgacatgttgggctgtgggatcccagcgctgggcctgctcctgctgctgcagggctcggcagacggaaatggaatccagggattcttctacccatggagctgtgagggtgacatatgggaccgggagagctgtgggggccaggcggccatcgatagccccaacctctgcctgcgtctccggtgctgctaccgcaatggggtctgctaccaccagcgtccagacgaaaacgtgcggaggaagcacatgtgggcgctggtctggacgtgcagcggcctcctcctcctgagctgcagcatctgcttgttctggtgggccaagcgccgggacgtgctgcatatgcccggtttcctggcgggtccgtgtgacatgtccaagtccgtctcgctgctctccaagcaccgagggaccaagaagacgccgtccacgggcagcgtgccagtcgccctgtccaaagagtccagggatgtggagggaggcaccgagggggaagggacggaggagggtgaggagacagagggcgaggaagaggaggattaggggagtccccgggggactgctcaatacagatacggtggacg

SEQ ID NO: 193837 - DNA, 366 bp, Homo sapiens
  Payload ID: 18283
  Gene Name: transmembrane protein 191B
  ENST ID: ENST00000613597
  CDS Start-End: 1-366
atggaggctgcggaggagctggacgcctggcagagtggccgggaactgtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaa

SEQ ID NO: 193838 - DNA, 1220 bp, Homo sapiens
  Payload ID: 18283
  Gene Name: transmembrane protein 191B
  Uniprot ID: P0C7N4
  ENST ID: ENST00000612978
  CDS Start-End: 180-1220
gatcagtttgcaagtgccatctgcagtgtgggggaaccaatcttcaacttgcctgcatttggtattagtattttattaacctttcattgatccaattacggctctttgacacaattttcatcagtgatggactaagtgtgatccggcctgacccgcctccggccggcgtgagaaggggcatgtgtcgggctacgctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggagcctgctgcggaggcgaagccaggcagcgcagcctctgcaaggggaggcgcgcgaggcggcgcgggagcgcgcggagcgggtgcgcagaagactggaggaggcggagcgccacaaggaggacttggagcagcacagcaggcagctgcaggagcagtgggaggagctgtcgagtcagctcttctacggaggggaaccgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaa

SEQ ID NO: 193839 - DNA, 354 bp, Homo sapiens
  Payload ID: 18283
  Gene Name: transmembrane protein 191B
  ENST ID: ENST00000613577
  CDS Start-End: 1-354
gagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggaggtgcaggtgaaggtgatggaggctgcggaggagctggacgcctggcagagtggccgggaactgtgtgacgggcagcttcgcggagtgcagtacagcaccgagtcgctcatggaggagatggccagggcggaccgagagacgcggctgttcggcggccc

SEQ ID NO: 193840 - DNA, 10012 bp, Homo sapiens
  Payload ID: 18284
  Gene Name: transmembrane protein 192
  Uniprot ID: Q8IY95
  ENST ID: ENST00000306480
  CDS Start-End: 147-962
agccggaggcggggcggacgcaggagggggtgtgtctggggaggggcctggcaggtcccagaaggtggcgagtttcgcggccagaggcttacaggtccaggtggagaggccgggctggccagggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggctgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcggagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactgaagtatttttcagagcaaatggcattatttctccatttttcctagtatgcccctttaatttgtcagtttgctgttagcactgttatatgctgccttagaaagacttttggttgaaggctgaatatgaggggaggggatatttatgactgtgttaatcttttttgatcattagctgaatattcaatatttgatatgtaaccatatagggatgtgttcgatataactatataggcaagggatatattgatttggccacatctatttgacttatggagggcaaatacctgtttcttttagatacagccattgccggggcattctaaaagttttctactaagataaagatgattgtgtatggctgggagcagttgctcatgcctgtaatcttagtactttgggaggctgaggcaggaggatcactcaaggccaggagtttgagaccagcctgggcaacaatgagacactgtctctcaaaaaaaaaaaaaaaagatcgtgtgtcacctgcacacaacattcacaaactaaagccaaattgtatttttaaaatttcctttctcccttccgtttttttttgttttttgggggtttttttttttgttgttgtttttgagacagagtctcaccctgtcgcccaggctggagtgcaatggcgcctttctttctttctttttttttcagacggagtctcgctctgttgcccaggctggagcgcagtagcatgatctcggctcactgcaacctccgcctcccgggattaagaaattctcctacctcagcctgctgagtagctgggattacaggcacatgccaccatgcctggctaatttttgtatttttagtacaggcggggtttcaccatgctggccaggctggtctcaaactcctgaccttttgatccgccctccttggcctcccaaagtgttgggattacaggcatgagccactgtgcccggccttcctttctttttaataagtgtatgtatctcaaagccattgccttctctagaaatctgtttctctgttctggaagagcctataaactttgccttcagttgtttttcttttcaaaagggaacaccagtggtagatgattaactcttatttatttttaaaatttaatttggatctatagtcagtatctgagatttataggatgaactttggtttacaaggaacagtgtagttaaaaagttagggtgcctatgttcttatgtaatcatcaacatgtttgttgtataatcatcaacatttttctgaatgcaatgatgaacatttcaaacaataaatgaaaatgaaactaagtatcagaagtagcaaaacagctgatgcagtggcttacgcctgtaatcccagcacttcgggaggctgaggcaggtggatcacctgaggttaggagctcaagaccagcctggccaacatagtaaaaccccatctttactaaaaatacaaaataagccaggcatggtggcacgcatctgtaatcccagctactcaggaggctgaggcaggagaatcgcttgaacacaggaggcagaggttgcagtgagctgaaattgcaccactgcattccagcttgggcaacagagctagactcgatctcaaaaaaaaaagaagtaacaaaacagaaaaatgaacaaaacaatttaaatgttaaacattctattcaccaggctggtaattgtgctagcactgaggatacaaaaattaaagactctggttggcagcttacattctaaagagagcgaggaatagatttccagactctgtgctaagtgcagtaatgacagtaggcccaacatgctgtaggagctccacgtcagggggtaccctgggggcaggagggtagagggttttaagaatgtcagacagaacaatgagtaaagtaggaaggcaaatagctacaaaatatcacaagcactgtgtatagctggaaccaaaagtgtgaggcaggacctgggtggagaggtagacagggtcagagcttggagggccttgatactatgctggaagactgcactttatcttgttgataatgggatcctctgaagcatttcaagcaaggaagtgacaatgtcagttttagtttcagcaggatcagatggtagttcaatatggaggaaatatgtgtggcagaaagatatggccctgaactagggcaggtatagtaaaccttttattataagtatgtatgtgtataggtatatagatagatataggtatatatgtatgtatatgtattccaaatgacaacagtatcatgacttattataaagttaaaagctcattttttaaaaaatggcaatatggaaaaatataaagcaaaacaattatttgaaatctcactaccaagggattataccaatgtacactttttttgttttgtttttttttttagtctcatctgtctcccaggctggagtgcagtggtgtgatctgggctcactgcaacctccttctaccgggttcaagcaattctcctgcctcagcctcccaagtagctagtactacagatgcatgccactattttttagtacaaaaatattaaaaatttgggtcgggtgtggtagcttacgcctgtaataccagcactttgggaggccaaggtgggtggatcacaaggtcaggagttagagaccagcctggccaagatggtgaaaccccatctctactaagaatacaaatatcagccaggtgtggtgcagggtgcctgtaatcccagctactctggaggctaaggcaggagaattgcttgaacccagcaggtggaggttgcagtgaggcaagatcacgccactgtactctagcctgggccacagagcaggctccatctcaaaaaaaaaaaaaaatactaaaaattttgtatttcggctgggcacggtggctcacacctgtaatctcagcactttgggaggccgaggcggacagatcacgaggtcagcagatcgaggccatcctggccagcatggtgaaaccctatctctacaaaaaatacaaaaatattagcaacattagctgggtgtggtggtgcgcgcctgtaatcccagctactcaggaggctgaggcaggagaattgcttgagcctgggaggcagagattgcagtgaaccaagatggtgccactgcactccagcctggcgacagagcagagcgagactccatcacaaaaaaaaaaaaagaaagaaaagaaaaaaaattgtatttctagtagagacggggattcaccatgttggccaggctgatcttgaattccttacctcaggtgatccacctgctttggcctcccaaaatgctgggattataggcatgagccagctcacctggtctccatacccttaccaatagtgggtgttaccttatttaagtcttgacccatctgatgagtgtgtcattgtttcaaattgtatttctttggatactaatgaagtgttaaacattttttccaaattatatggtcttttataaatcttttatgacatgtatattcaagtcctttgcttattattgtcccaggatattctttttcttaacaactagaatcttctggttgggcgtggtggctcccgcctgtaatcccagcactttgggaggccaaggcaggcagatcacttgaggtcaggagttcgagaccagcctgaccaacatggagaaaccccatttctactaaaaatacaaaattaaggctgggcgcagtggctcacaccggtaattccagcactttgggaggccgaggcaggcggatcatgaggtcaggagttcgagaccagcctgaccaacatggagaaaccccgtctctactaaaaatacaaaatagccaggtgcagtgaagtgcacctgtaatcccagctactcaggaggctgaggcaggagaattgcttgaacccgggaggtggaggttgcagtgagccgagatcgcaccactgcactccagcctgggtgacagagcgagactctgtctcaataaataaataaataaataaataaatcttgaatacaaaactcacatctggtaaactcttgagttcttgaagaatcaaactttgaatatgtgacaatcacaaatttgagatctcaaaacattctctaggtttcctaaggaaaattgtttcattcgcaaaccagggaagcctatctctaattcttctcccttcctctctatccagtctcacctttcactctactactctactgaaactgttcttggcaaggtcaccaatagcttccttccacattgcttaaattggagatgaatgcatacgtctcctcttttaacttatcagcaacacttggctcagttgattgagggggggtctgcccctccacacctgtgggtatttctcgtcaggtgggacgagagactgagaaaagaaataagacacagagacaaagtataaagaaagaacagtgggcccaggggaccagcacacccagcatgcgaggacctgcaccggcgccggtctcttgagttctgttagtatttattgatcattatttttaatatcttgacgaggggagtgtagcggggcaacaggtggggagaaggtcagcagggaaacgtgagcaaaggaatctgtatcatgaataagttcaaggaaaggtactgtgtccggatgtgcatgtaggctagatttacgtttctctttacacaaacatttcagtgtagcaaagagtaacagagcagtattgctgccagcatatctcgcctccagccacagggcagttttctcctatctcagaatagaacgaatgggaatggtcagctttacaccgagacattccattcccagggacgagcaggagacagaagccttcctcttatctcaactgcaaagaggcctccctctttcactactcctcctcagcacagaccctttacaggtgtcgggctgggggatggtaaggcctttcctttcccacgaggccgtatctcaggctgtctcagtgggaggaaaccttggacaatacccaggctttcttgggcagaggtccctgcggctttccgcagtgcattgtgtccctggttaatcgagaatggagaaaggcgatgacttttaccaagcataccacctgcaaacatattgttaacaaggcacatcctgcacagccctaaatccattaaactgatccaatacagcacatgtttctgtgagcacagggttggggctaaagttataggttaacagcatctcaaagcagaaacaatttttcttagtacagatcaaaatggagtttcttatgtcttctttttctacatagacacagtaacaatctgatctctctcttttccccacagttgatcacttcctccttgactctttatttcagcttggcttccaggacactacattctcctcattttcttctacttcactagcttcttcttttgtctgctttgcaagttgctttttgttggtattctccagggctcaacccctgggcctcttggcttctccatcagcgttcactctcttggtggtctcacacaatctcatgactttgatagaatttatgagctgataatttccaaatgtgaatcttcagccaggccttcctccctgaactccagacttatgtgtccaactgccccttctagatcactacttgggtatataaaaaaacacctcaaacagaacatgtccccagctgagctatctgccacagtctcttccacccctgtaatggcagctcctctttctctcaaaccctatagacagttaatcagcaaatcctgctggcttttcctttaaaacatacccagagtccaaccaattcttggcacccccaatgctacttccccagccactataatcttcacctggactattataatagtctttcggttttttggttttgttttttttttttgggggagggagtctcgctctgttgcccaggctggagtgcagtggcgcgatctgggctcactgcaacctccgcctcccaggttcaagtgattctcttgcttcagcctcctgagtagctgggattaccggcacataccaccacacccagctaatttttttatatttttagtagaaagggggtttcaccatgttagccaggctggtcttgaactccggacctcaggtcatccacccgccttggcctcccaaagtgctgcaattacaggcatgagtcactgtgcctggccctattataatagtgtttttctttttctttttctttctttcttttttcttgagatggagtctcactcgtgtcgcacaggctggagtgcagtggcgcagtctcggctcactacaacctccgctgcccaggttcaagcaattctccttcctcagcctcctgagtagctgggattataggtgtgctttttttatttttagtagagacgaggtttcaccatgctgactaggctggtctggaactcctgacctcatgatcctccctccttggcctcccaaagtactgggattacaggcatgagccaccacacctggcctataagagtcttttaagtgatctttctgcttctcactacctctccaccctgaccccccagccccatgcacacacacaaaaagcagccaacaatatccttctaaaacactactctgatggttccctttttcattcagtaaaagccaaagcctggacagtggccttcagggacctagaaaatctccacttcccaccccaccccacctcctctctcctactcttcctttgtgtaccctgcgtcggtcacactgtggcttttggattgctaagcacattcttacctgaggacctttgcggttgctgttccctctgcctggaaggatcaactcccatatatctttttcaagtctttgttcaaatgtcacttgtggccaggtgtggtggctaacccctgtaatcccagcactttgggaggctgaggtgggtggatcacttgaggtcaggagttgggagaccggcctggccaacacgatgaaaccctgtctctactgaaaatacaaaaattagccaggcgtggtggcacgtgtctgtaatcccagctattcaggaggctgaggcaggagaatcacttgaacctgggaggtggaggttgcagtgagccaagatcgcacagctgtactccagcctgggtgacaagagtgagaatccgtcccccccccaaaaaaaaaaaatcctcccacttcagtcagcctcctgagtagctgggattatagatgtgcaccacaccaccacacgtaacttttattatagtatattgctataattattctattttgttattaatgttgttactctctgtgcctaatttataaatttaactttattgtagttatgtgtggataggaaaaaatatagtgttcgtagggtttagtactatctgtggctccaggcatcacctgaggtcttgcaatgattcccctgcagacctgtggctccaggcatcacctgaggtcttgtaatgtttcccctgtagataaggggaaaatactgcatgtaacttacttgtttactttgtctgtgtctcctgatagaatgtaagctctatcttttgcttactactgtgtccttcatacatagaacagtgtctggcacaaagtaggcactcaatatacgttgatgaattaatgtcactaacttcagtgatttcactactggaattgtagtagaaaaactatgctcacacatgctcaaagcctgttcctgtaatccagctgtaacctgggctctgttttcactttctgtttatgatgtcctgaactgagagattatttttttaaggtcttgtttaaaagtttatgtctaggatacactaaaaaataacaacatatcagaaataaaagagataagactgcta

SEQ ID NO: 193841 - DNA, 789 bp, Homo sapiens
  Payload ID: 18284
  Gene Name: transmembrane protein 192
  ENST ID: ENST00000505095
  CDS Start-End: 536-789
tggcgagtttcgcggccagaggcttacaggtccaggtggagaggccgggctggccagggcttcggcctccggcgtcgggaaatggcggcggggggcaggatggaggacttgagaaaatggaaaattaactgtaagacctggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcag

SEQ ID NO: 193842 - DNA, 2225 bp, Homo sapiens
  Payload ID: 18284
  Gene Name: transmembrane protein 192
  Uniprot ID: Q8IY95
  ENST ID: ENST00000506087
  CDS Start-End: 184-987
accaaagaaaaaagacacctgtgcctggcaggtcgatacgctactaatttgcccgaggtacgaacgaaacagaagatgctgatttctggataaaacgttctgcagtgccaggctgcagtgtgttctactgaatgcatgtaccataatttacttaattatctgggctgattctgaatttctattatgaacaaagccacaggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggctgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcggagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactg

SEQ ID NO: 193843 - DNA, 3975 bp, Homo sapiens
  Payload ID: 18285
  Gene Name: transmembrane protein 196
  Uniprot ID: Q5HYL7
  ENST ID: ENST00000405764
  CDS Start-End: 698-1216
gaggaagaggacgacgacgagggagaagaaacccagacggaaagaggccatcagacaaggtcgctttttctggcgacaaagcaactgcaaggagcgtggtgctgaatatcatccgcccgctctgcctggggacccagagacttgcagaagcacttcgcattgccacgaaaacaaaggagaggtgacgaacgggagagggagagagaaactcggagcggttccctttggatctccgggaagcaaagctcctctcctcggcaataaaacagaagggaccctgtgaaagggtctagtaggctgaggagggcgcgggtttccctgcggagatttgggacgcggcagaactctggacagcgcctggggagcaaggctcggagctccctgggctcctccaggttttccgctgcttaaaagccccggtaccggtgtgcaatcttcgcaccaccgaacccaggaagatccttctacgatccctatctgaacgtgccagggggtggagcagctcctttgcctctggcccagccagggaaggtcttcgtttctggaaatccagcccttgtggataatgcctcgctcttgaagaaagaaaagttttgggatctggtagggggtggaaggggtaaggaggatagtggaagaaaaaaaggtagatggttgatttccctctctgatctggaaggaagatgaccgaggaaggatgtgcaccagcggtcagattattgggagcctcttggtgctctccgtgctggagatagggctgggggtgtccagcgtggccgtgggggcggtcagcttcagcctggccctccgagagcacaagccgcagctcggagactcgtccccgtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaacactatttgactagcatgattattatatttgtaatgacatatttcatatgagtaattgaaaagtgcaaatatcaagaaataaaaataacttattgacgtctttgttctgaaagacagatggcttcaaggatgctacaattcaaaacctcagtaatgccttgttataaaaacattgtaattattttcaacttgtgaatgaaatatatttcataatttatttgtaaatgacaaaaaacctcaagcataaaaaagagactttttagagagagagaatactaatctatatggtatttttgcatttttgcacaaagagtgaaaagttatatgtgaatatcatttaagaaaataaacatgttttgatcatactgtgcagattgatctgcatgttcatgaatgagcctaagaataaagtatgtgtgtgaatgtgtgtatacatactgtaaatatagaacatgtatacagcatatattatagcatacatgaatgtaaataggtattagaaaagaaattgtgatgctgtgggggtattattaagattctactccaatagaaatgggaaggcaattgctcaaggcccttctatgcccacaaaatcacatgtttaatttctactaaaattgcccatttttcttcttttaattaggttttgtgtaaatatcattgtgggtgatatttatgaagatgagtgatctgaatagtgtagtatacagatagactacttatttgactatttcactatgattatagtatttatgtatagcaattaaaattaatttataaacgaacatgactttaatgacatacttccgtatttataaagatatcatgacttaaaattattgatgatattgatatttcaaacaccttgcagtccagttaaatgatacaaaagggcagatgatgtaaccccccaacaatgaagttataattacctttgctgtaatctaatttaggtgttttgttttacgattctcatgaaataatataggcagtccatatataagaaagcctatatccaaagatcctgaaagaattctttgaggaaaaagtgaaaagataggctaacatttgtatagctagattcaatcctttcctctaataatggaatgttaaaatagcaaacaagaacaacacatataagtgaaaaaacaacatatatctgaatatatttatcagaatataacctctggcaacagacaaagaaatctatcatttttaaatacataactctcactatattgtatacttttctttttcctcaaatctaatcaattttcaagtcattttttatgagttacttgttgaaccataggtaaattaaaatatttactgttcagtatgagaatataatttataaacaaaacatgagttttaattgtgctaacacagtaatgatcattcaagttaatgaaaatttgaaggtcttttatagcaacatgatcatcgtttaacctatttaaatcagctcacttaaaattctggctgtcatctattcaacagaaataactggactctgcttgtttggtgcactttttgaagtctcccaattcctttggataacttcattgcctagtagattacagaagttgtccataaatgcaacctcatatagtgaatcaacatcataactattcattcaatgccacaaacaggcatgatctttgccaatgaaaatctaaattacatcatgaagatatttgtgtgtgtatggtcctcctgaattcatgcaaggatgtagttttgtactgaaagaataaacactgactctaattttcagtagcatttctctataaacatgcttgttcaatacaaaattataatacatcagaaaaatgttgtaatgccttttgaactgatctataacataacacattaaaggacaaaaggagacatatcactgctttgatgtatagttaaaaagagatgccatcatcacaattattcaaatagtttacagtgtatgtttaaccaagtatagatatatttttaaatatgattatttctacctagtattttcagaattgagtttagaatgatttacttgggatgtgcggcgattcttttttagataagtgggggatgttaggaagacattgttcaagtgcttgaaactttaatttggacaatacattgaaccacatgctggaatgttttaagtgactaccttatagttttagtatgagcctacccttggaagaaagtaaggtgatactaaattagaaaaactatgtgaaactggagtggtggtatactttggaccatatcaaataggtagagtattataagcataaaagaataaaattgggctcgctttggaaattttaaacatatatgtgtatgtgtgtatatatatgcatatacatacacatatgtgtatatacacacacacaatggtttggaagtggaacaggaaatgataactctactgacatgtctataataaaatgatgtgctttgaaact

SEQ ID NO: 193844 - DNA, 4054 bp, Homo sapiens
  Payload ID: 18285
  Gene Name: transmembrane protein 196
  ENST ID: ENST00000405844
  CDS Start-End: 697-1236
aggaagaggacgacgacgagggagaagaaacccagacggaaagaggccatcagacaaggtcgctttttctggcgacaaagcaactgcaaggagcgtggtgctgaatatcatccgcccgctctgcctggggacccagagacttgcagaagcacttcgcattgccacgaaaacaaaggagaggtgacgaacgggagagggagagagaaactcggagcggttccctttggatctccgggaagcaaagctcctctcctcggcaataaaacagaagggaccctgtgaaagggtctagtaggctgaggagggcgcgggtttccctgcggagatttgggacgcggcagaactctggacagcgcctggggagcaaggctcggagctccctgggctcctccaggttttccgctgcttaaaagccccggtaccggtgtgcaatcttcgcaccaccgaacccaggaagatccttctacgatccctatctgaacgtgccagggggtggagcagctcctttgcctctggcccagccagggaaggtcttcgtttctggaaatccagcccttgtggataatgcctcgctcttgaagaaagaaaagttttgggatctggtagggggtggaaggggtaaggaggatagtggaagaaaaaaaggtagatggttgatttccctctctgatctggaaggaagatgaccgaggaaggatgtgcaccagcggtcagattattgggagcctcttggtgctctccgtgctggagatagggctgggggtgtccagcgtggccgtgggggcggtcagcttcagcctggccctccgagagcacaagccgcagctcggagactcgtccccgtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaaagattgagggctattgaaataaccgacttgcccagctgcccggtggtgcccccgacaccagagttacctacaaggaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaacactatttgactagcatgattattatatttgtaatgacatatttcatatgagtaattgaaaagtgcaaatatcaagaaataaaaataacttattgacgtctttgttctgaaagacagatggcttcaaggatgctacaattcaaaacctcagtaatgccttgttataaaaacattgtaattattttcaacttgtgaatgaaatatatttcataatttatttgtaaatgacaaaaaacctcaagcataaaaaagagactttttagagagagagaatactaatctatatggtatttttgcatttttgcacaaagagtgaaaagttatatgtgaatatcatttaagaaaataaacatgttttgatcatactgtgcagattgatctgcatgttcatgaatgagcctaagaataaagtatgtgtgtgaatgtgtgtatacatactgtaaatatagaacatgtatacagcatatattatagcatacatgaatgtaaataggtattagaaaagaaattgtgatgctgtgggggtattattaagattctactccaatagaaatgggaaggcaattgctcaaggcccttctatgcccacaaaatcacatgtttaatttctactaaaattgcccatttttcttcttttaattaggttttgtgtaaatatcattgtgggtgatatttatgaagatgagtgatctgaatagtgtagtatacagatagactacttatttgactatttcactatgattatagtatttatgtatagcaattaaaattaatttataaacgaacatgactttaatgacatacttccgtatttataaagatatcatgacttaaaattattgatgatattgatatttcaaacaccttgcagtccagttaaatgatacaaaagggcagatgatgtaaccccccaacaatgaagttataattacctttgctgtaatctaatttaggtgttttgttttacgattctcatgaaataatataggcagtccatatataagaaagcctatatccaaagatcctgaaagaattctttgaggaaaaagtgaaaagataggctaacatttgtatagctagattcaatcctttcctctaataatggaatgttaaaatagcaaacaagaacaacacatataagtgaaaaaacaacatatatctgaatatatttatcagaatataacctctggcaacagacaaagaaatctatcatttttaaatacataactctcactatattgtatacttttctttttcctcaaatctaatcaattttcaagtcattttttatgagttacttgttgaaccataggtaaattaaaatatttactgttcagtatgagaatataatttataaacaaaacatgagttttaattgtgctaacacagtaatgatcattcaagttaatgaaaatttgaaggtcttttatagcaacatgatcatcgtttaacctatttaaatcagctcacttaaaattctggctgtcatctattcaacagaaataactggactctgcttgtttggtgcactttttgaagtctcccaattcctttggataacttcattgcctagtagattacagaagttgtccataaatgcaacctcatatagtgaatcaacatcataactattcattcaatgccacaaacaggcatgatctttgccaatgaaaatctaaattacatcatgaagatatttgtgtgtgtatggtcctcctgaattcatgcaaggatgtagttttgtactgaaagaataaacactgactctaattttcagtagcatttctctataaacatgcttgttcaatacaaaattataatacatcagaaaaatgttgtaatgccttttgaactgatctataacataacacattaaaggacaaaaggagacatatcactgctttgatgtatagttaaaaagagatgccatcatcacaattattcaaatagtttacagtgtatgtttaaccaagtatagatatatttttaaatatgattatttctacctagtattttcagaattgagtttagaatgatttacttgggatgtgcggcgattcttttttagataagtgggggatgttaggaagacattgttcaagtgcttgaaactttaatttggacaatacattgaaccacatgctggaatgttttaagtgactaccttatagttttagtatgagcctacccttggaagaaagtaaggtgatactaaattagaaaaactatgtgaaactggagtggtggtatactttggaccatatcaaataggtagagtattataagcataaaagaataaaattgggctcgctttggaaattttaaacatatatgtgtatgtgtgtatatatatgcatatacatacacatatgtgtatatacacacacacaatggtttggaagtggaacaggaaatgataactctactgacatgtctataataaaatgatgtgctttgaaactatatat

SEQ ID NO: 193845 - DNA, 768 bp, Homo sapiens
  Payload ID: 18285
  Gene Name: transmembrane protein 196
  Uniprot ID: Q5HYL7
  ENST ID: ENST00000433641
  CDS Start-End: 90-359
agcccagaaaggagccacggggagaagcggagtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaaattgagggctattgaaataaccgacttgcccagctgcccggtggtgcccccgacaccagagttacctacaaggaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctat

SEQ ID NO: 193846 - DNA, 775 bp, Homo sapiens
  Payload ID: 18285
  Gene Name: transmembrane protein 196
  ENST ID: ENST00000422233
  CDS Start-End: 90-425
agcccagaaaggagccacggggagaagcggagtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaaagattgagggctattgaaataaccgacttgcccagctgcccggtggtgcccccgacaccagagttacctacaaggaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaa

SEQ ID NO: 193847 - DNA, 687 bp, Homo sapiens
  Payload ID: 18285
  Gene Name: transmembrane protein 196
  Uniprot ID: Q5HYL7
  ENST ID: ENST00000493519
  CDS Start-End: 151-465
agagagaaactcggagcggttccctttggatctccgggaagcaaagctcctctcctcggcaataaaacagaagggaccctgtgaaagggtctatttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctt

SEQ ID NO: 193848 - DNA, 2393 bp, Homo sapiens
  Payload ID: 18286
  Gene Name: transmembrane protein 198
  Uniprot ID: Q66K66
  ENST ID: ENST00000344458
  CDS Start-End: 586-1668
ctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccatgtgacgtcagaagcagcccgcccctgcctggatggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtg

SEQ ID NO: 193849 - DNA, 2218 bp, Homo sapiens
  Payload ID: 18286
  Gene Name: transmembrane protein 198
  Uniprot ID: Q66K66
  ENST ID: ENST00000373883
  CDS Start-End: 395-1477
gtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaa

SEQ ID NO: 193850 - DNA, 1057 bp, Homo sapiens
  Payload ID: 18286
  Gene Name: transmembrane protein 198
  ENST ID: ENST00000421791
  CDS Start-End: 377-1057
tggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctc

SEQ ID NO: 193851 - DNA, 505 bp, Homo sapiens
  Payload ID: 18286
  Gene Name: transmembrane protein 198
  ENST ID: ENST00000451952
  CDS Start-End: 38-505
gtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctg

SEQ ID NO: 193852 - DNA, 3148 bp, Homo sapiens
  Payload ID: 18287
  Gene Name: transmembrane protein 199
  Uniprot ID: Q8N511
  ENST ID: ENST00000292114
  CDS Start-End: 91-717
agagcaacttccggtgcgcttagcgttacttccggcgcgcggcgggcggaagtccgggttggggtcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaacctgagctatataaaatttgtgttaaaaagctacactgggccaggtgaggtggctcacacctgtaatcgtagcattttgggaggctgaggcaggcggatcacttgaggttgggagtttaagaccagcatggccaatatagcgaaaccccatctttactaaaaatacaaaaaaattagccaggcgtggtggtacatgcctgtaatcccagcactttgggagaccaaggtgggaggatgcttgagttcaggagtttgagaccagcctgggcaacatggcaaaagcccatctctacaaaaaaacgcagaaattagctgacatggtagcgcacgcctgtagtcccagctactcaggaggctaaggtgggaggatcacttgagcctgggaggcagaggttgcagtaagctgagtaagccaagatcatgctattgcactctagcctggatgacagagtgagaccttgtctcaatgaaaaagcagggggcactgggaggggagaaccaaatgccctatcctccagttctcagcatatagaagggagctctctcatctgctagccactcctgcctcactgtgccatgctttctgtaatgcactctgggtccagggactgcttggcaggaggtgggaagaacaagaagtttagggccttcccagtttcttagggcctgtctggagagggaactagcgtttactgagtttttacgatgtgttacacaccatgtaaagccctttacctacattatttcttataccccaaacagagagcaaataagtatccccattttttagtcacatagagttccagagttgccacagttacatcgcaaagtcaggatttgaatccagtgcagaccgcaaacaccatggttttctctccaaagcagagcagctccagaggtggaggtgactggaatgtcctagattcagtgggaccaggagctgggggtgctagcagaggctctcatctccccagggtcttgtcagtcagagtcctaaacccttcaattaactatccctctaatcccagctgaagcctgggtaatacctcccaccaagaggtatctgtgtggaacctggccctatttagggattaggtgatggagataaatttccatggcaaacggccctcgtccccgttcgtttgcagagcacaacaatccagattaaggtacagagtttgggttttatttggagattagttggtattacaggtgatggtgataccaaaacccaatgctgctatacctgcctccatcccagatctgtcaggttgtctccacagccccacatcagagggcatccaatctgatctttgtgaaaattaaatcaacataagcccca

SEQ ID NO: 193853 - DNA, 578 bp, Homo sapiens
  Payload ID: 18287
  Gene Name: transmembrane protein 199
  ENST ID: ENST00000580868
  CDS Start-End: 25-294
acctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaaggggtgagccccagtctccagtccgggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatgg

SEQ ID NO: 193854 - DNA, 674 bp, Homo sapiens
  Payload ID: 18287
  Gene Name: transmembrane protein 199
  ENST ID: ENST00000555264
  CDS Start-End: 30-407
gggtcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcagtagagaccacgttggccaggctggtcttgaactcccagcctcaaggtgatcctcctgcctcggcctcccaaagtgctgggattacaaggatacaagacatggtgggactctcagcgacctgggaaagcaaggtgagtgagatcattgaaggctctggtcatcaccatcttcaatttcattgtcacggtggttgctgccttcgtctgcacttaccttggaagccaatatatcttcacagaaatggcctcgcgggtgctagctgcattgatc

SEQ ID NO: 193855 - DNA, 971 bp, Homo sapiens
  Payload ID: 18287
  Gene Name: transmembrane protein 199
  ENST ID: ENST00000395404
  CDS Start-End: 664-768
gaatttctcgtggatgacaaatttgcttgtgcagtttctgctcttttgagagccccctcttcacttccaggcacacctaggcccaattcacccttgagaaagtctaggtttttaccaaatacaaatatcacaggttttgtctcttctttttctccactttaggaatcagcttagcatagtgagcttgtaggaatccggatttctttccacctcaaaagcaagagtggtgaaatctgatactttgttttgtttgtttgtttttttaatataggatggcaaaagctgtgttgaaagatctggcctgagagtagcatgtgagttccagtcctagctctgtcactaatcctttgaaggagtcatttctcctcgctgggcctcagttcccttatgtgtaaagggaaggaacaggacaaactagcacataagaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacac

SEQ ID NO: 193856 - DNA, 675 bp, Homo sapiens
  Payload ID: 18288
  Gene Name: transmembrane protein 2
  ENST ID: ENST00000377043
  CDS Start-End: 1-531
ggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagtatgtttctgttactgttatttcaaatagttgagcaagtagtaatttagtggagaaaaagaataacttatgtctcctttgcagcaagcaaagaaagccaattttacatactttgcttctcttgtggggaggctgtatattttgtgttgatggaattaaagagattatacaaattgaa

SEQ ID NO: 193857 - DNA, 6523 bp, Homo sapiens
  Payload ID: 18288
  Gene Name: transmembrane protein 2
  Uniprot ID: Q9UHN6
  ENST ID: ENST00000377044
  CDS Start-End: 541-4692
cggcccagccgagccgggctgcttgtctggccggcggaggctgagcgcgaccctagcaagccgcggcgcccgccgaccagggacaagagcgactcctgggaccccactctgccccgcgccgccgcctcctcccctgttgtcgcggggacgctcaggcccgcgccgcccgggccacgattctcctcctctttctcccggaggggaaggaacggagaaagccgagcggcggctccgggagagagcgagccgaggcccctgcccccgaggctcggggcaggaggaggaggaggaggaggaggcggaggcggagggaagtgcgcgtcactctcgggaggagagtatttcacctccaggcagaggctgcggctgccagttgagtacgagcggcagctgcgggcgccggcaatcgagtggcttcctggccatggagaggagatctggacccgaggacgccagggactcctctccgtctccctggaccgctgtgtaggcacctgagttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgttcaggctgacactggcaatgagtacagataatttcactttcctcttctaggggcaaaggctgatggcctctacctttgtatccaggagaaactgcagagcagccctgtgactttacaaaatatgctacctcaaagtgctaccgataaacctttctaattgtaagtgcccttactaagggcacatgtcttaatcaaagttagttttttgttttctggtttgttttttttttttgtatattgatgaatgagatcttacctattaaatatattattggattatggttcctgaaggtcattagagtgtgtgtgtgtgtgtgtgtgtgtgtgtgtgttttatgacttaaatatctttacgtgtgttttttagagcttggttctttaaagatttggagaagatatgtaaattaccaaggcacttggtttttctgttttatatactaataatcagggcctaagttaaataaaaatatgtgtgcatgtatttta

SEQ ID NO: 193858 - DNA, 722 bp, Homo sapiens
  Payload ID: 18288
  Gene Name: transmembrane protein 2
  ENST ID: ENST00000377055
  CDS Start-End: 1-537
ctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacgggagacggtgtatccctatgttgcccaggctggagtgcagttcacaggcatagttgtggtacactacagccttgatctcctgggctcaagtgatcctcccacctcagcctcacaagtagctgctgccaccacacccagcattgattttcaatttttgtttagacttaaacaactacctggactttcattctgtagatgatagaacttccagattcccacttgattttccacaagaataaaaagaatatccacatttggaa

SEQ ID NO: 193859 - DNA, 5217 bp, Homo sapiens
  Payload ID: 18288
  Gene Name: transmembrane protein 2
  Uniprot ID: Q9UHN6
  ENST ID: ENST00000377066
  CDS Start-End: 43-4005
gttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaaggtgcatcactgtgcatgggacaaatggcttgctaataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagagg

SEQ ID NO: 193860 - DNA, 1437 bp, Homo sapiens
  Payload ID: 18288
  Gene Name: transmembrane protein 2
  ENST ID: ENST00000396272
  CDS Start-End: 166-1296
cacttagtctggcacagatcacagaatctcccttttcaaagttgagacacttgactttgtgctgaaaatgtctttttagctgtttaaattttcattctcttccctttacttcttgattattttttcaaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaa

SEQ ID NO: 193861 - DNA, 5372 bp, Homo sapiens
  Payload ID: 18288
  Gene Name: transmembrane protein 2
  ENST ID: ENST00000542935
  CDS Start-End: 43-1785
gttaacggacgctaagcggggtaggggaagtaacagtgtatcatgtatgccactgattccaggggacactcccctgctttcctccaacctcagaatggaaatagtcgtcacccatctggctatgttccagggaaggttgtcccattgcgtccccctcctcctccaaagagtcaagcttcagccaaatttacctccatcagacgagaagaccgggcaaccttcgcattctcacctgaagaacagcaagcccagagagaaagtcaaaagcaaaagagacacaaaaatactttcatttgttttgctattactagtttctcattttttattgcacttgcaatcattttaggaatatcctcaaaatatgctccagatgaaaattgcccagatcaaaatcctcgtctcaggaattgggatccaggacaagattctgcaaagcaagttgttatcaaggagggagatatgctccgtctgacctcagacgccaccgtgcattctatagtcattcaggatggaggactgcttgtatttggggacaataaagatggatccagaaatattactttgaggactcattacatcctgatccaggatggtggggcgcttcatattggagcagaaaaatgccgctataaatccaaagcgacaattaccttgtatggcaagtcagatgaaggtgaaagtatgccaacatttggcaaaaagtttattggtgtggaagctggcgggacactggagttacatggggcacggaaggcatcgtggacgttgttggcaaggaccctgaattcctcaggcttgccctttgggtcctatacctttgaaaaggacttttcccggggcctcaatgtgagggtcattgaccaagacacggccaaaattttggaaagtgagagatttgatacccatgaataccgcaatgagagcaggcggcttcaggagtttctgagattccaggatccaggtcggattgttgccatagctgtcggggattcagccgctaaaagtctcttacaaggaaccatccagatgatccaggaacggttgggaagtgaactgatccaaggactgggctacaggcaagcttgggctttagttggtgtcattgatggtggaagcacttcttgcaatgaatccgtgagaaactatgaaaatcatagcagtggcgggaaggctcttgcccaaagagaattttatactgtggatggccagaagttctctgtgacagcttatagtgaatggattgaaggcgtttctctttcaggattccgggtagaggttgtagatggagtgaagctaaatttgctagatgatgttagtagttggaaacctggagaccagattgtggtcgcaagcacagactattccatgtaccaagcagaggagttcactcttcttccctgttctgaatgcagccattttcaggtcaaagtcaaagaaacccctcagttcctgcacatgggtgagatcatagacggtgtagacatgagagctgaggttggaattcttacccggaatattgtgatccaaggagaagtggaggactcatgctacgcagaaaatcagtgccaattttttgattatgatacctttgggggacacattatgataatgaaaaattttacttcagtccatctttcttatgtggaattgaaacacatgggtcagcagcagatggggcgataccctgttcattttcacctgtgtggtgacgtggattataaaggaggatacagacatgcaacatttgtggacggcctgtctattcatcacagcttctcaagataaaagacaccattgggtttgacacactaggtcattgtttctttttggaagatggtattgaacagaggaatactttgttccacaatctgggactcctcaccaagccgggtactctcctgcccaccgataggaacaactccatgtgtaccaccatgcgagataaagtgtttggaaattacattcctgtgcctgctactgactgtatggctgtttcaactttctggattgctcatcccaacaataatctgattaataatgcagctgcaggctcacaggatgctggaatatggtatttattccacaaggaaccaactggggaatccagtggattgcagctcttggcaaaaccagaactcactccattgggtatattttataacaacagggtccattcaaattttaaggctggcttatttattgacaaaggtgtcaaaacaaccaactctagtgctgctgacccaagggaatacctctgtttggacaatagtgcaagatttcgacctcatcaggatgcaaaccccgaaaaaccacgtgttgctgctctaattgacaggctcattgcttttaaaaataatgataatggagcttgggtcagaggaggagatattatcgttcaaaattcagcatttgcagataatggaataggactgacctttgccagtgatggaagcttcccaagtgatgaaggttccagccaagaggtatctgaatctctctttgttggggagagcaggaattacggctttcagggtggtcagaacaagtatgtaggcactggaggaatagaccagaagcctcgaacattacccaggaacaggacgttcccaattagaggctttcagatttatgatgggcccattcatctcacaaggagcactttcaaaaaatatgtgccaactccagataggtacagcagtgcaattggcttcctcatgaagaattcctggcagataacccccaggaataatatctccctcgtgaagtttggtccacatgtctctctgaatgtcttttttggaaagcctggtccctggtttgaagattgtgagatggatggtgataagaactccatattccatgacattgatggctctgtgacaggatacaaggatgcttatgtgggaagaatggacaactacctgatccgccatccaagctgtgtaaatgtgtctaagtggaatgcagtgatctgcagtgggacctatgcacaggtctatgtacagacatggagcactcagaatctttctatgaccattacacgagatgagtatccgtccaaccctatggtgctccgaggtattaatcagaaggctgcctttccacagtaccagcctgtcgtcatgctggagaagggttataccatccactggaatgggccggcaccacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaaagccacaggcatggccacagttactgttcatctcagggatgtgaaagagtcaagatccaagcagccacagactcaaaggacatcagtaactgcatggccaaagcatacccacagtactacagaaagccgtcagtggtcaagcggatgccggccatgctcactggactctgtcaaggctgtggcactcggcaggtggtgtttactagtgatcctcataaaagttacctccctgtgcaattccagtcacctgataaagcagaaacccagcgtggagacccgtctgttatttctgtcaatggcactgactttaccttccgaagtgcaggcgtcctcctccttgttgtggatccgtgcagcgttccattccgcttgacggaaaaaacggtttttcctcttgctgatgtcagtcgcattgaagagtatttaaaaacaggcatccctccaaggtccattgttctgttgagcacaagaggagaaataaagcagttaaacatttcacacttactagtacctctgggattagccaaaccagctcatctttatgacaaagggagtaccatatttttgggattcagtggaaactttaaaccatcatggactaagctatttaccagtcctgctggacagggccttggggtgcttgaacaattcatacctttgcagctggacgaatatggttgtcccagagccaccactgtccgcagaagagacctggaactgctaaagcaagcttcaaaagcacattagagactaactgtaacttaagtgctgggggaaaaaaaatgtgaactaacttatttaatttatggcattttaaaatgacactgttaacccaacggaaccattttccagtttgatacagaatggggagaaaagaaagcgtttgaaattattgcttggataccagcttcatgcaccttctagttgtacaaaatgttaaagacgttgtttgtatttgtaaggctggtgtattcagagagcagatctcttattcctcactttccacccccgtattttgtaatgaccatgagcaatgtttttactttttgtataatggggtggggtggagtgggggcttctgagagtcagcctgaggtctttagaggaccagctattgtagcaccttggatacttgaagtttaatgctcagttgggtcgggtggcagttgacttggtggctggcatgttcagcagtgcctggggccctgtttctgggcagcctttgaggattttctatgatattgaatgacagttttaagtggcaactcaggcccagctcatgcccttttttgcctggacatgtgctatttttattcacttatatatcaattacttgtaagggttaaactttcaaacaggaagtatattgggacaaaagggctcttggggattagatatccctttaatctgtgaccattgggcaaaaaattttcctgcagcaaaagtctgaggctgttgggaccatttttgcagctttaatccttagcctcttttgactgtatatttgtgtttaaaatgcagagctcaactgaatatttccttttttgttttgttttgttttgttttaagaagtaggttgttttcctgaaccgtaaacttgtatcattttaacttgcacaaaggaagtctgttcttggtattgctcttgcacttgggttttttgttattgttttgtgtggattttttaaagcttttctgttcaccctcctgccaggaaaatcccagaaagcttaatgataccccaaaatgattacacccagggaggaaaaaaaggagcgctttctagggtcagaatcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagagg

SEQ ID NO: 193862 - DNA, 533 bp, Homo sapiens
  Payload ID: 18288
  Gene Name: transmembrane protein 2
  ENST ID: ENST00000545719
  CDS Start-End: 479-533
accacttcacttgtgtgtgaacataagaagtatgactctgaaatgaatgcttcatgacagcaaggatcatgtctttctttcttgttcaacaccctatgtccagtgccttgaacagttcctgacccatgattttctgaaaactttactcctttgctgcacttcaagtctgcaaaattgacaaatgaaagtgtcggggcagttggggagaaagaggccttcagatatactctataaatcatcaaaatatgatgtgctatatattctcggcataaactggaaatgaaaaaaacttgctacaaataggagtgactcctttgggcttaaattggattggcagcaacacagattctgctgtggattgaagtcattttctacctcggcactactcagtccatggggaatggtgaagttatgattttgcagcaagattctgggagcaggccagcatctacatctgttctaaacttaacagtgtatcatgtatgccactgattccaggggacactcccctgctttcctccaacctcagaatg

SEQ ID NO: 193863 - DNA, 3512 bp, Homo sapiens
  Payload ID: 18289
  Gene Name: transmembrane protein 200A
  Uniprot ID: Q86VY9
  ENST ID: ENST00000296978
  CDS Start-End: 872-2347
ccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagcacacagagccgctgaaaacgactgaagagagcaagggatttcctgggacatctggctctggagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcag

SEQ ID NO: 193864 - DNA, 5017 bp, Homo sapiens
  Payload ID: 18289
  Gene Name: transmembrane protein 200A
  Uniprot ID: Q86VY9
  ENST ID: ENST00000392429
  CDS Start-End: 2379-3854
gcaagcatttaggaatagcatttgccaactcccaagacttggctgtccctctcgctctggccttacttacctaactgacctcctgtagtactgagttgtgtgctggccaagttcctattcctggactgctttctttcccttgaccttccttgaaatactgctaacctgacttttgactgtgatctatgtgctatctcctgtgtgaagcctaatgaaaggtccttctctaatggaaactttcattctaggagttacctcattctgttttatgtggatctgttagctccttcattaggtttcaagctgtttgaaacagtgattgaatttgctcacctttgctttcctctcagggtctacattgggaccctgagtgataatagagccttctgtagtattgaattgctttaaacagaattaaaggacattggcaccaaatgtgattttgccaatccttgggagtcttggtgcctctgtctgggcttgaccagggtagaatggctgaagaaaatgtgattcctccacccattaaattctttatttctcaactactctggaagtttttgcctctttttgtttctatccattttcatacttttaagatacccttttttactttaagataccttttttcttcctaacgtttctttacatgctcacatgcaagcccagtcatccatctctctttttcacctttctgtcctcatatatttttcttaaaatatcttttctcatctaatctcctttcctctatcaatcagcctcctaagcgaaaatggtagtgctaatgttttaaaaagtgggggaggactagaaatctgtatggaatgtaattcacttttattgcttttaaattaaatgaaacgtttttgcccttgtttccattctactcagaaggatttcagactaaatccttaagcctgccatatggaaataactgggctagagggctgctatctaatctaagcatttaattcaaacatttgaaatggtttttgcttcaagaaaacataggttgacactaagctttattttagcaaaggtttgggaaaggttctaatctgcagtatgtacactttgataaatttcatagactagagcaacagattacaatttagtttgttcttccaacataaaactattttaatcctagttataatttcactgaaggctggatttactcactggcttgttaaaactgtagataacaaccacaagcctgttatttaaacacaattcagaaatcataaatagaaattcaaaaggagagctcaatgctgcaagatgagatttgatgccctgaagaaactctctctgaaatttgccaaagaccttgtggaacttaaaatatcttcttgtttcctaccagctagatatggcagcttgagaactatttattatgaatcaagatagatattttaccaactcagaaaatgttgctttttgtttggatattaatcttgtttgttcatatttttaactaggaaagttagtacagtaatatggtggtcatccaacagaccacaagaagagaatttgtccctcattcagcattttagcaaatatttcttgaacactagccatgtgcaaggtattacagtgagtgtttctgctaataaaaatatgaattaaatttgatgtttgatcataagtagaagaactgtgatactataatattgtaagtgccatagaaaacttgctattataaaatgctgtaaggagttaatgcttgcatagggtgcagtgggtcagctagagaaggctttataaagaaagtggaatatgagctttgatgcctagccagatgtgggtatgtgaagaacagggcagggcagtggggagtgggtggattctggacagctgaaacattgttaacaaaatctcagaaatggtacaaaatggaatatgaatgagaaatacagaacatttgttaggttttatttttatgcaaattaaagagaagagttagagacaaagttaaagtcaatgggtctagaatttcagctaaaactttggtaggtagtggagaatattttatcattattctgctctttaaacaacttcagagatgattgattaatcttgattgtaaaggaagagaaattctttggaagaccagttagggggttatcatatggtctagtaaaagttaataagatctgcacaaggctgggaagagtaggattagaacagaggggtggaattaaaggacatcgtatattggaaatttctaggatttagaacctgattggaagaggaagaagaaagggaggagttaaaaataactgtaaagagccaaatctgagaactgaccctgctaaaaaagtcagacaagtcaagtggtgcagctggtgtgtgctagaagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 193865 - DNA, 2918 bp, Homo sapiens
  Payload ID: 18289
  Gene Name: transmembrane protein 200A
  Uniprot ID: Q86VY9
  ENST ID: ENST00000545622
  CDS Start-End: 280-1755
cagctcagtggctctcaaacctcagcaggcatcagaatcacctggaggacttatgaaaccagtttgctgggcccgcttggtccagcgcttctgattcagtagggagaagtggaaccatgaatttgcattcccgacaagctcacaggttataccagtgttgctggcccgaggattgtattttgggcagcattactccatctgaactcttcttgttctcttacctccttacgtcccaagactcgcggatgttagtttattctcagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 193866 - DNA, 2899 bp, Homo sapiens
  Payload ID: 18289
  Gene Name: transmembrane protein 200A
  Uniprot ID: Q86VY9
  ENST ID: ENST00000617887
  CDS Start-End: 261-1736
cttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 193867 - DNA, 2501 bp, Homo sapiens
  Payload ID: 18290
  Gene Name: transmembrane protein 200B
  Uniprot ID: Q69YZ2
  ENST ID: ENST00000521452
  CDS Start-End: 101-1024
ccgggccgtggagacccgggcggctctggagcctccgcgcgcggactgggacccggacccgcgcggcgctgcggcgccagagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccttctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcgagagttg

SEQ ID NO: 193868 - DNA, 2553 bp, Homo sapiens
  Payload ID: 18290
  Gene Name: transmembrane protein 200B
  Uniprot ID: Q69YZ2
  ENST ID: ENST00000420504
  CDS Start-End: 159-1082
gtcttgatccgagcggtcttcccggtgtctagctcaagtcgctcctgctgcagcttcgctgcgggcggaggaggtctggaaggagggggcgggcagggagaggctggagccggtgacgccccctcctcccgcgctgcgagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccttctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcga

SEQ ID NO: 193869 - DNA, 1920 bp, Homo sapiens
  Payload ID: 18291
  Gene Name: transmembrane protein 200C
  Uniprot ID: A6NKL6
  ENST ID: ENST00000383490
  CDS Start-End: 42-1907
cctccatcccagaggctagtcctgcactccaggagctcgccatgatcgccaccggcggcctgctaaggatttccgccagaaagcaggatccactccgccccccaagccagatacccaagcgcaagcggaaagccaagaagaggcgcaagaacgacgtggtggtggtgaaaggcaagctgaagctgtgctccatctcagggctcatcgccctctgtgggatcctggtgctgctggtgggcatagccatggcggtggtgggctactggcccaaggccaccgggaccaatcgggaggggggtaagcagctgccgcctgcgggcagcagccaccgggtcccaaccacggccaacagcagtagcagtggcagcaaaaaccggtccaggagccaccctagggctccagggggtgtcaactccagttccgcgggcgcgcccaggagcacgcctccagcacgagccgcctccccgtcctcctcctccacgtccgtgggcttcttcttccgcatcttctctggctacctgcactctgacaagctcaaggtcttcgggcccctcatcatgggcatcggcatcttcctcttcatctgcgcaaacgcggtcctccacgagaaccgggacaagaagaccaaaatcatcaacctgcgggacctctactccaccgtcatcgacgtgcacagcctccgcgccaaagacctggcggccgccgcggccgccgccgcggccgccgccgcctcttcgtcgtcgtctgcccccgccgcggcgccccccggggccataccgctcaacggcttcctcagctacgtgcagtcgcggggcctggagctgaagcccgggggctgcggtggctccggggacgccttcggagcggcggcgatgctggccaagggctcgtggcctcctcaccccgcggcgccgagcggcggccgccctcggggcgccgcgtccccgccggacctggcctcttccccgcgctgtccgcgggagcccccgagcctggccgaggccgtgtacagcgtctaccgcgagcgctcgggcgtggcaggcagtcgccgggccgccgctgccaccgccgccgcagccgctagcagctgcagcagtccggcgccctgcagcccacccgagagctgggggcgccagagcacggccagctccttcgtggactcctcgctgagcgccttcgcgctgctgcccttgcaagggggccgcgataggggcggggacgcggagggcgcgagctgcagctggcagaggcctccgggggaacgcggctcccaggagatcccgaggggcgagctcgacctgagcatgaccaacctccgcggcgcagagggcagcatgcgcggggcgcgccgggagccggaggagcccgagggcgcggtagcggcgcgcgccgccagggggcagggcggccgcctgcccaggaccggcaggtacgcggccttgcggcgccgcagcaccagcgggctcccggactaccgggcgccgccgtcccccgagcccccgccctccccggggagtgcggacccggactccagccctctggccaaggccgcctccccctcgccacccctgcggctggagggctcgccccccaccaggcgggactccgggagctcccagtcggatgacccatccagcagcaataagggctacacacccctgcgggaggccggcacctccaccgagtcggtcttggacgcagtagctggtcaaacgcgagactctgctgtggccgcccccgttctgggtgcggagcagagctcgccggagggtgccagccaggagccacccacggccgagcaacctcagccggtgcagaggcagtttacaaacaaggagaaactcatcatgatttccaggtctcatgccataggggtagaagaagaactggaaagcacaggcatttagagaaaggggtggg

SEQ ID NO: 193870 - DNA, 10638 bp, Homo sapiens
  Payload ID: 18291
  Gene Name: transmembrane protein 200C
  Uniprot ID: A6NKL6
  ENST ID: ENST00000581347
  CDS Start-End: 647-2512
gcggactctggcccctagctccccgagagcgcccctcggatgctgctggggagaccctccgggcctctctttggggcctctggggcccgcggctcagacagcaacagccgccagtccggccgccccgagccgccgccgcgggctcaactccacccggcggagcccggcgcgccgcagccacacaaaagaggcgcgagggccggcggcgcggccgcaggggcccgcccgggagcgccgcgctaggggacgccgggagctggaggatgagcggcggagaggagggctccgaggcgggatgcgggatgcgggatgcggaggacctgacacttcttggaaactcttggaaatggctcccgccacagcgccggcggggactgcgagcctggggcgggcgctcgcccccgcggggctgctgagtcgcgctcggatgcggggccccggggcgctgtccctgcgctccgccgtcggctcgggctgaaaaagtttctccatggttcctttgtgtcgcccgagcgcccgttcgccggccccgacctccctcggtctccctggcaggaggaggtggctgagcagctagtgggcagttggcgccctccctgtgcaagcctccatcccagaggctagtcctgcactccaggagctcgccatgatcgccaccggcggcctgctaaggatttccgccagaaagcaggatccactccgccccccaagccagatacccaagcgcaagcggaaagccaagaagaggcgcaagaacgacgtggtggtggtgaaaggcaagctgaagctgtgctccatctcagggctcatcgccctctgtgggatcctggtgctgctggtgggcatagccatggcggtggtgggctactggcccaaggccaccgggaccaatcgggaggggggtaagcagctgccgcctgcgggcagcagccaccgggtcccaaccacggccaacagcagtagcagtggcagcaaaaaccggtccaggagccaccctagggctccagggggtgtcaactccagttccgcgggcgcgcccaggagcacgcctccagcacgagccgcctccccgtcctcctcctccacgtccgtgggcttcttcttccgcatcttctctggctacctgcactctgacaagctcaaggtcttcgggcccctcatcatgggcatcggcatcttcctcttcatctgcgcaaacgcggtcctccacgagaaccgggacaagaagaccaaaatcatcaacctgcgggacctctactccaccgtcatcgacgtgcacagcctccgcgccaaagacctggcggccgccgcggccgccgccgcggccgccgccgcctcttcgtcgtcgtctgcccccgccgcggcgccccccggggccataccgctcaacggcttcctcagctacgtgcagtcgcggggcctggagctgaagcccgggggctgcggtggctccggggacgccttcggagcggcggcgatgctggccaagggctcgtggcctcctcaccccgcggcgccgagcggcggccgccctcggggcgccgcgtccccgccggacctggcctcttccccgcgctgtccgcgggagcccccgagcctggccgaggccgtgtacagcgtctaccgcgagcgctcgggcgtggcaggcagtcgccgggccgccgctgccaccgccgccgcagccgctagcagctgcagcagtccggcgccctgcagcccacccgagagctgggggcgccagagcacggccagctccttcgtggactcctcgctgagcgccttcgcgctgctgcccttgcaagggggccgcgataggggcggggacgcggagggcgcgagctgcagctggcagaggcctccgggggaacgcggctcccaggagatcccgaggggcgagctcgacctgagcatgaccaacctccgcggcgcagagggcagcatgcgcggggcgcgccgggagccggaggagcccgagggcgcggtagcggcgcgcgccgccagggggcagggcggccgcctgcccaggaccggcaggtacgcggccttgcggcgccgcagcaccagcgggctcccggactaccgggcgccgccgtcccccgagcccccgccctccccggggagtgcggacccggactccagccctctggccaaggccgcctccccctcgccacccctgcggctggagggctcgccccccaccaggcgggactccgggagctcccagtcggatgacccatccagcagcaataagggctacacacccctgcgggaggccggcacctccaccgagtcggtcttggacgcagtagctggtcaaacgcgagactctgctgtggccgcccccgttctgggtgcggagcagagctcgccggagggtgccagccaggagccacccacggccgagcaacctcagccggtgcagaggcagtttacaaacaaggagaaactcatcatgatttccaggtctcatgccataggggtagaagaagaactggaaagcacaggcatttagagaaaggggtgggttggggaggaggaaagagaaaatgggagaaacgcccacttgaatcagtgcattaacaggtccctgtttcttttgtggactgatccgaggacatcattcaatatccaaagagctgcagaatgttatccttgaattgcgtccacaagattcctgtagataactccaaggatttttttttttaagcaaactagtctttttatgtccgatggtgattgtatgttcaatgaaaaccaaatgtattaaaaggtcagcaatctagtccattagataaaatcttttaattttcttaggatcaaaataatatatttttgacagtaactgtgcactttactccgacttttttttttaatccctcatttcccgacccctgtactctgcgctggttttgcccacagctgcttgcgaatggcaggcttttttctccattcctttgcggaacatagaagagtttgtctcagttctcttagaattgatgttactaactgaagtcaaagccaaaagcatgaataattcaggaacgagcactttccttgccccaccccactgtgctcacccaatgcccaaaagcttcttcatttttaaacgggtgtgtacgttttgctactaggctatgtggtggagactggaggggaccaggaactagatggactgttacattccgaaatttatatcaagtacaccatgctttattgagtgttatcacacctgtattgaaaatagcattaatatttaaaatcttttttaataaaagaagtttccgaacaaacagttaaacataatattgcctcatttgccttggagctagctcatctggtacctctgaaatattttgctgtgacactgctaccaggactgttgtgatcttcccccaaagtactcagcaccattgtcgcatgtccagcgtatttttaagcttaaaatgtagggtagtatttaacatttgggaatttctctttcaaatagaatgaaacgttaagtaaatagtaatatgcctatgatacttctcatttacctgcaagtattaatttgcagagcaccaggcttaatattctcttcccatcctcttggctatcactgattataagttaatggtcttgatccatggcctacatagacaaaaagataatgttttaataatttggtagattgtttacacttgatgtcattaaaagtgaattagttaattttcaagaccaggagacaagatgtcttcattttggtctccttgggcaaagcgctagtcctgtagacagagtgcagattccgagctgagattggacccagctgttggcatctcctagctgtgaggccttgtacaagtcacaaactctgagtctcagtcatctttctgtaaaatgaagagaaccagacatatctcatggagctatgagaggaatagaacagggtcagggtcagaggagggtttatatgtgtggagtttaccagaacccttggcccacaggatgtattcaatagatgggggttattgtaattattattaccattgtaatatattgctgaatgcatagtgtagaagaatggaccttccttgaacttgagctcaagaaagtctagtctgaaatctgggatatccacctattatctgtataaccttagacaaatcacttaatccctctgggcctctggtagatgatataatctctatgatcttcagctctaaaagccttacttaaattcaggctcttgtcctggatgtaatcatatcacatttgtacctacaacttggcaaagagtgaatatacgtcgtcaattaccattagctcaacattctgtaatacactttaaaagggcctaatttattctcagattggatctgcattaaaccggtaactcactttaaggctgtagattaatatattgggctcttctataaagcaaaagtgagtttgcactaaggagtgacatgcaagtgtaataagacctcaaggtagtgttaaatttcaacagtctcaattgctttatcacacttccaaagtaaatgtcaaacttccttaggttttcttctccattaccttgggtactgggtaatttatatactgagatagcgtgttacttcaaggggaaaacaggttctggtgttctacaatactgtttccagtcctcggagaatgcactgtaaatgttacatttatcaaatgctaagtgacatttagcaaataataaagctaatacctcttagcttaactaaggaggggtggacagaatactgtttatatctcacaaacttagttccatatcagataatatctaacttaaccattgaacaatttaactagattttttttctgaagatagacaaagatgagctcaattttccaaatcttgggaggagcctgtgatttctttagacttcagaggaagtgtataagtgtagtaattcacaatcgtaactttcataggagcagaaatctgcaataatgctaattttcactcagtacttactgtgggttcagtactattgtaggagcttggtacacatgatctcagtgaatcctcacagcaactctattgaagtaggatcattcttaccgctgttttgcagagaaagacactgaggtcagaaagatggaattgttgtccagggttacacagctggtaaatggtggatccaggatttacacagagtttggaagattaggtagacctgtcggcagatgctgagttgaaatgggcatttctggagaccatcaaaatactttatatattctttatttcctgccagatccctttccagaccattcttagagaaatgcagaaaattgtcagaatgcacagtcagataaaaagctggagttcgtaaatcttcagacgggcatgaacaagtttttttgtaagtgacttttcaggggtttttgtacacaataaataagagtatttgaaagggccttatagatgatagaatccccccacctttaatttataaatgaggtttctaagatttagaaagatggaacaatttattctgagacaaacagcagtggcaggactcgaatgttaaattaaaataattgcaacaattggtgtgatggtattttttccctgaatttctgtcatgtaccagctgggtgaccatggacaagttacatagtctctctgtgtctcaatttccttttccacactataggaataataatgtccctatcttacaggactggagtaaagattaaatgaactaatatttgtgtaaagtgcttataatgggcttggaacatagagagtattatacaaaggtttgttccttttatttaaaatagaatcaactgctaaacaattacttcatatgaccttcctttttattaatagaataattttaggcttaaaaatctaaagtataaggcaacatagcatagtggctcaaagtgtgacttagggggttatataacattataactgggtcttcacatctagtaaatggagataataaatggaatttggcacatagaattaattatttaaatgaggactaaataaactaatataattaaaggacttagaacaactcctggcacataaaaatattcagtaaatgttaactactattattaaggcaaaatacagaaaagcaattagtaggctaaatttactactcagtagttagggacaaccataaacttaatgtactaaaaagtctttaaaatttaggtatatcagaaagaaaagttagaccttaaaacatgagggcttatgctgctgcaatgcctcctggtagaacatagaactatcaagagctagacatatgctccttatggtcccaggatcataatattatataacaatgaatgaacgcccaaactggcacacttggctatatttagccacaattattgcatttccatttattgaggctagccgtatcagaaaggccagtgaagtccttgaggtctcagccccctattaggcttcaagtaaagatcaggtgctctattgagttatttaaattgtctagacaaaagttttttctatattaatttttttcttcagtaattttgagttctttaagatgcagttttgatttttttttgagctagagaacttaagaaaaaccctctgacacataaaattagtacagactaagtatatggacttgtatttggattaggatagtatttttgccacgatataaaaatacattttataaataagatcttcttgtattaagggttgcagtttaagatggatatttttcttacttataacaaagaataggttgatgtttacggagtttgttttccataaacccagactattttaaaatttttattgctatttggaagggaggaataaaactcattgggtgaatatttagactaaatttttgaatgactaactctgaaaaacaatctaagacaccccaccctaccccagggaagttatctttggggttttttcttcaaaaaggaatgagattcttctttaaattgataagaaaattcaatgttttatctattaagccaccaccagttaaggagtccaactttagtcaaactacctgcaactctgccaagacctgagaagctccttactttctgtatgccatccgttcatctatgacatcagaaaagcactgtgctagtgctgagcccacatgggtgtgaactacagtaggagttacaaatgccagccatcctaaggacttagccttcatcccagagccagaagcatttcaggatttccaccacctggaaagatattgttattccacttgaaatgggctcttagctgttgcccctttaataatgccagctatgacatggacatgggctgattcgttagtaagataacatactgtcattgctggtgaaaagaccgaaaaagattatgcagattctcctggagtgttacaaagtatgggcctgtctcaataacctgtgctttctgatcctacattgtgaccaagtcccacgaaggctgactgtcaataacaagggaggaaaataggcaggcccaggggtggaagaaaaagagcatcctgccgaaagaaaaaaaaagataggccagaatcactagggaagctttttgtttcataaaggagcatttggttactcttgtttacagatcattttgtatgtaaagtgtcttaaaaattgcaataacttttattccttagcaaatattctttttgcaaatgcatggctagacattaattcatatattttttaatatttaagaaattcaacacaacattgtattattgatgcaaacccacttgatactagtaaatgctaaacacctaataatatttaataattgaaaataaatttatgggcaaatttatgaacaatttattttaagttgagaaactccagtatctttaaactatgtctatatgtctaaagaaaaaaaaatctaaaagttattaatgactgatataactaggtcagtcgaagcaaaccggatcagaaaatgactttgtctcagtggaggacttttgctattgttttatgtggctaattgccttttcactcccttttgtatagacacaacctaaaaaacacctgatttcacctgtatagtaagcagctgtgtttcaagcttctgcccttttggtaaactacacaaattgctttcagatgagtttcagatatattatactctgcctatcatgagtcagataggcactgtggtaggtagaaaggacaaaaatatcctttttgtgtctgtgaaagacacaatttctgaccacagaatcttgtaatagtattgtttctgagacaggcacataaaccataattttactataatgtgaatattacaagagagttatgatacaaatcttccagctgagtcttgagaaatgaagaaaatgtcagataggtacaaaaagctgggaaaggtgtgttggccagtggggccagcatgagcaaatgcagaacacaaaacacaatttaaaaagccagatgttcataaggtaattgatatttaattattacctagtatctccatagcatagaggtgtttattttggaaaaaaacaacaaaaacaaaacaaactatatatctctgatctatagatatagataaatagatgtctcctttataagtagcagaaggatattcgaaattaaaattacgatggtttggcattaaaatgctcaaaatatatatacctacattctatatttaatgattcatttttaactgaccttcactagcagggcttcttaactgagaagtatcagtacatagaactaacaaactaaattcttattggacctaagctatctttatgagcaagaatgatttttgctgaattatacattgctttaaaattaccattaaatttgaaatttcagattctggaaatcatttccctagacgtgtgtataaggagataaaactgagaggagaatctgtcacttggcaacactgtttgcatcatggatcaagtgtgttgatccatgtaccgtaaagactggagacagcataaacttgggggttgttctatcaagccacaggtcatttttcagaatctacacatgataactgaatatatttctacagatttctacatcaattttgcagcagcatttatatcaggaaacataaataatttatctttgttaataataaacatccgtttttttgttcctcacgtatgcgttcatagcaaaaggaaaggttaagacccagacatactgtcgcaaatgtgtatgagtattgtttgtggactggcaccaaaaacactatgccttttgatttttaaacagccagtcattttgagatagtcactgaaaacagatttggccagaatagcaaagtatagatgcagcttaatactttgtttatgcacaaagctgcaaacaaaaagatacaggcaaaaaacctgcttttcaaaacaaatattctattaaagtaaaaaaaaaataattttattaacaaaagtataattttgttagtttgaattcctcacataattacttgatttcttcaaaatctttttagtgcataaacacagtcaaggcaaacatataaaatgtgttttctaatccatgaaagtgagaattctgcaaaaccactttgcattatagataaaatttaatagatatcatcagttatggtttattgtcagagccactaataattcttccataaggttatatctattggtaagaagattaaaaattggaaatgctggtagataaagtgctgtggttaatatgtcatggtaaatgatatcaggaagcacatagaattcttgataaagagcaagaaaattcaaaagactaatttggtgacctaaatactaatccttctgcttatgtaaccattgcaggttaatgtgtttggagcactaaatacgacttgagtgcttgctcatttgattgtacaatttattctctttgtatttctagttttatttcagcttcatgcctgagaacatctcttgatttattaatcttgcttgggattactactttaaaaaattgaatgcatttatagtgatagtaatagtaataataataatagtcttaaaaaagaccgaaaagtaatttgagcactaataataagtaattgtttgcgtcccaattttttatatcttctcaaatagagagtaaattgactgatatcttctggaaacatgtgccactgaaaagccaaaacacaattgaagtgcatgtttgcaatctcctcgttcctcaaatcccatggatgtccaaaactagaacctttctttgattcatgtaggatattctgactaagtcagagagatgctggtgaatgctttccaagatttcttttattataaagtgaatggaaaggacatttaataatgctatacctgcctgaaaaaaatgccagctttcattaagtcagtggcaattaaatgcaacacttggcaaataaattgaacaaagcatctggctagcctgtaagtatgaatcatcttcaatggaagtaccaaattatagcaaaaaaaaataaagggatataaaaaggaaaataaaattcagacatgattagggccatgagtaaaaataatccaagttgatatgtggcaacttgtaatgcagcataattttagaaaattatttagtgaatgtataaatgtgacatgcctgaaaaatgttaattaaactggtttacgcaatggt

SEQ ID NO: 193871 - DNA, 3776 bp, Homo sapiens
  Payload ID: 18292
  Gene Name: transmembrane protein 201
  Uniprot ID: Q5SNT2
  ENST ID: ENST00000340381
  CDS Start-End: 10-2010
cggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggttcttcccaggagactctgccggccttttccccaccagccccagcttggccatccctcacccgagtgtcggaggctctccagcgtctctgttcatccccagcccgcccagcttcctgcccctcgccaaccagcagctcttccggtctcctcgacggacctcaccctcctcattgcctggccgcctcagccgggccctctctctgggaaccataccctctctgactcgagcagactccggctatctgttcagcggtagccgcccaccatctcaggtgtctcgatctggggagtttcctgtttcagattacttctctcttctgtcggggagctgcccctcctccccactcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtttggtgctgacactctgatcccgaagccagggagccccaaggggctgcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccccatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggggggccttcagatctcagatgagactgcaccccttcgaccaccctactgggcacctgcctccagcccctgagaactccatcttcccctagttctgcccaggagcccctgagaaccccatcttcccctggttctcttgcccactcccctgctggggctccttcctggcactgaggaggggcgctcccaatgctgtgaggcagcggggagggaccgtgcacccgtggctatcagagcccctccgctgtcccaccctgggcctgggacacgggcctggggcagtgtgtgtctgctggtcatgtgctggtgccagttggggaggaatcagctgtctcggtggattctgagactcactgtggggcgggaagaagggtcttcactctgccattcagggataaagtttaattttatttttctacacattttgccaggtcaggcattttgctagtaagcaggatgcccccaactctccctgccatggaggattcttttttttaagctttgggtgcttttttaatacttttttttttaatgtggggaaggagcttgctctgacgtcaccctcctctcccctgactcctgtcctgagagctgtggatgccgcctcctgccctgcctacccctgaaacgtggggaatgggggccccaggacagcatcaggacttttgagtccagctgccagcaatggttccaactcggaggcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaa

SEQ ID NO: 193872 - DNA, 3851 bp, Homo sapiens
  Payload ID: 18292
  Gene Name: transmembrane protein 201
  Uniprot ID: Q5SNT2
  ENST ID: ENST00000340305
  CDS Start-End: 10-1188
cggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggtcagagaagcagccatgactgcggggggaggacacacggatgctcaggcccaggctttgccaggtccgaagcgggcccctctctgtcctgcctcttttcacctgctcacgccctcccacccccaccctacagccccaggtcctggcccagtccctccactgcctcgaagagtcagtctgccctgccttttcctttcgggcaccaccagccatccccgagtgccctgtagccactcaccactgctgccacctctctggccaatggccctttcactggcctggtgactggaatgtgggcagcgcccacacaggctctggcccatggcttcctactggcagctccaggcacccccctctcaccacgccgtttgctggctctgacactgttgggtgagggtcctggtcctgctgtcttcccttctggcctctgcacaggggtggtgacagtggctacaggctgggcccctggcgtgccctgaccgtgcagcagagtgaggctggggcagcagagagccccagcctcacccctgaggagcacctgtggtctgtccccttggtcctgcttatggctggaccggccctgcaggaggtggtggagccgtgaaggaggccgagctgcagctctggctgctgcttggcctcctgctccaagaccctcccgagtccccggaaatggagagtgcagttcttgggcccagcctggccttcgccatgagtttggggagcgagaccccacctgagacaggcagtaggagcctgtgctgaccttggggaatctgagcttttccaagggtaaggggcccagggtatgcaggccttcagtgacatcaggtcgttgtcatcctttccctccctgacctgtcacgagcctctgcaggtgcctgctcaccatggcccagcgccactctgtcctccgactcaggtgagggggcagcccacagacctgctcctcagtagcagggcctggccaggcccctgctgttctcagcctcagtttgccatctatgaaatgaggtggacccctctccatagcccttgggtgccagctcagtgggtgtggggatcacatgaggtggctcatgaggacacactctggaagtcgaggggctgccacgtgcagaggaagttcccggcctgggggctttatccaggggtcccagtcgagagtggcccgaggccgtccctcaccgggcatgttccctctggctgcccactccctcagggcccacatgtcctgccactcgccactctgagcacgagttcaccttccagatgtggccagggtgtgccagctcctctctcctgtgcgttggaaccccgggggaggcaagagcagatcacaggtgcatgagggttacacccgtcacctgggtctgccgggatgggttgggggggcaggtgccaggcctcactgctgtgaatctgccacgcctgggggtcctagaggctgccccaccccagtgattgggtagcagctcacatcccacccagcttcacaagtgaggaacccaggtgcatcgggagaccctcgggggcttctgtggcctctgtgcccgatgacctgcgtggcttcagacaaggccccagcgttactgggctcagcttgttgttctgtgtggagcgtgaggtgagaaaacccctctgaaaagatgtggtcggggccacgcttcccactggttctgcagtgaggagttggggcgggtgagccaaagcggccccccatggtgtctacctgaggggcagggaaccgcctgcctgtgcactcacgccaccccccagcccacaaagagcccatctgagagaaggacgtggtggagccaggacgggaaagcgtcctgtcggctggccatgctgttgcttgcgtctcgaatcttcggttctcgaggaagtgttgacagtgtgatgctaatgtctgcttttcttggcgttgggtagaagcaggacatctgtgtgtatgtgcgtatttaaattagattatttataataaccagagccagccctcgcgctggccaggatcctcctgccgagctgatgtcgctcctgccctctgccggggtccggaagcgacatctcaggaggtagctctcagcagagtgaggattcctgcctttcgtagagttttgtgtgactttttaaattattcatgtgtcccttaaaagtttcactacgtggagaaaattccagcaccaagtgttgtggcaacagctgagagagtgcaggcaccactgtgttgtggcttgttgaccgggaatgtgtcacccctgccagggaactcttctcctcgcgggggacttgggatggccatcagaccttctagggtctggctggggtcatcctaggtatgggtgaccgtccctgagacataagcgaggtagattcagccatcctcaccctcagacttgaggtccccacccaggccaagccggccccccgtaccccttgcctgggagcaaaccgccaggacgcagcctccacgccgcacctgccacattcagccctgcccaggaaggaacacatgacccttctgtctgtgactgttgctgagtctctgtctcatgtcgtagaattgtggataattgtctagtgaccctctcatcactgtaaccatcgcgcctggcctagatgtcgtgttttggatgctgtgttttcaataaatgcctctggggccctgcttttacccgc

SEQ ID NO: 193873 - DNA, 3447 bp, Homo sapiens
  Payload ID: 18292
  Gene Name: transmembrane protein 201
  ENST ID: ENST00000416541
  CDS Start-End: 1-1657
ggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggttcttcccaggagactctgccggccttttccccaccagccccagcttggccatccctcacccgagtgtcggaggctctccagcgtctctgttcatccccagcccgcccagcttcctgcccctcgccaaccagcagctcttccggtctcctcgacggacctcaccctcctcattgcctggccgcctcagccgggccctctctctgggaaccataccctctctgactcgagcagattacttctctcttctgtcggggagctgcccctcctccccactcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtttggtgctgacactctgatcccgaagccagggagccccaaggggctgcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccccatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggggggccttcagatctcagatgagactgcaccccttcgaccaccctactgggcacctgcctccagcccctgagaactccatcttcccctagttctgcccaggagcccctgagaaccccatcttcccctggttctcttgcccactcccctgctggggctccttcctggcactgaggaggggcgctcccaatgctgtgaggcagcggggagggaccgtgcacccgtggctatcagagcccctccgctgtcccaccctgggcctgggacacgggcctggggcagtgtgtgtctgctggtcatgtgctggtgccagttggggaggaatcagctgtctcggtggattctgagactcactgtggggcgggaagaagggtcttcactctgccattcagggataaagtttaattttatttttctacacattttgccaggtcaggcattttgctagtaagcaggatgcccccaactctccctgccatggaggattcttttttttaagctttgggtgcttttttaatacttttttttttaatgtggggaaggagcttgctctgacgtcaccctcctctcccctgactcctgtcctgagagctgtggatgccgcctcctgccctgcctacccctgaaacgtggggaatgggggccccaggacagcatcaggacttttgagtccagctgccagcaatggttccaactcggaggcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaaccaaaaaagatacagcctttgaat

SEQ ID NO: 193874 - DNA, 893 bp, Homo sapiens
  Payload ID: 18292
  Gene Name: transmembrane protein 201
  ENST ID: ENST00000508400
  CDS Start-End: 1-499
attgcctggccgcctcagccgggccctctctctgggaaccataccctctctgactcgagcagactccggctatctgttcagcggtagccgcccaccatctcaggtgtctcgatctggggagtttcctgtttcagattacttctctcttctgtcggggagctgcccctcctccccactcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggttgaccttcagggtcctctgtttcttggaactgatcgaaaacacatcacgcattgccagacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcaccta

SEQ ID NO: 193875 - DNA, 1012 bp, Homo sapiens
  Payload ID: 18293
  Gene Name: transmembrane protein 202
  Uniprot ID: A6NGA9
  ENST ID: ENST00000341689
  CDS Start-End: 55-876
gtgtgaggagatgcagagacaaattccgtggcagttagagaactaactgccaagatggagcgaagggaacatttaaccttgactttccacagtcctgaggttcccaaaataaaggggaaccggaaataccaaaggcctaccgtccctgccaagaaacatccaagtgcctcgatgtcatgccaaaggcagcagcagcttatggatcaggcacacatctacatccgaacgctctgtggcagcctctgtagttttagcctcctaatgctgatcgccatgtccccactgaactgggtacagtttctggtgatcaagaatggccttgagctctacgcaggactctggaccttatgcaaccatgagctgtgctggagccacacacccaagccaccctattatctccaatattccagggccttctttctcatctctgtctttaccatacttactggccttggctggctcttcagctcttggatccttaatcgaggaagcatgaccaccaacttggatctgaaggtatccatgctcagcttcatctcagctacctgcttgctcctctgcctcaacctgtttgtggcacaggttcactggcatactagggatgccatggagtcagatctcctatggacctattatcttaactggtgcagtgacatcttttacatgtttgctgggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtc

SEQ ID NO: 193876 - DNA, 588 bp, Homo sapiens
  Payload ID: 18293
  Gene Name: transmembrane protein 202
  ENST ID: ENST00000567679
  CDS Start-End: 19-204
agagaactaactgccaagatggagcgaagggaacatttaaccttgactttccacagtcctgaggttcccaaaataaaggggaaccggaaataccaaaggattatctccaatattccagggccttctttctcatctctgtctttaccatacttactggccttggctggctcttcagctcttggatccttaatcgaggaagcatgaccaccaacttggatctgaaggtatccatgctcagcttcatctcagggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtc

SEQ ID NO: 193877 - DNA, 724 bp, Homo sapiens
  Payload ID: 18293
  Gene Name: transmembrane protein 202
  ENST ID: ENST00000568167
  CDS Start-End: 23-208
agttagagaactaactgccaagatggagcgaagggaacatttaaccttgactttccacagtcctgaggttcccaaaataaaggggaaccggaaataccaaaggattatctccaatattccagggccttctttctcatctctgtctttaccatacttactggccttggctggctcttcagctcttggatccttaatcgaggaagcatgaccaccaacttggatctgaaggtatccatgctcagcttcatctcagctacctgcttgctcctctgcctcaacctgtttgtggcacaggttcactggcatactagggatgccatggagtcagatctcctatggacctattatcttaactggtgcagtgacatcttttacatgtttgctgggatcatctctcttctcaactacttaacttccagatcgcctgcctgtgatgaaaacgtcactgtgattccaacagagagatcaaggctgggggttggtccggtgactacagtatcacctgctaaagatgaagggccaaggtctgagatggaatctctaagtgtgagagagaaaaatttaccaaagtcaggactgtggtggtgataggaaaacctaactatagcttgtcttaaaagcaggggagaagctgagttgggaatggtcacataaattctgggaaactctcctaatatcatgtccatattacttgaggagacagcattaaagctgatgaaatgtc

SEQ ID NO: 193878 - DNA, 1557 bp, Homo sapiens
  Payload ID: 18294
  Gene Name: transmembrane protein 203
  Uniprot ID: Q969S6
  ENST ID: ENST00000343666
  CDS Start-End: 225-635
ggcgtccgatcgaggcgggcgttcacgggcggccagggttgagtcccgggtcggggccgggggattgccggcgcatcagggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggtttccctattccaatcctgtttgaaatggtttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgaactttggtttgatgccagtcaggtgccacatgagaacctttgctgagatgcaaataaagtaagagaatgttttcctgaaa

SEQ ID NO: 193879 - DNA, 1686 bp, Homo sapiens
  Payload ID: 18295
  Gene Name: transmembrane protein 204
  Uniprot ID: Q9BSN7
  ENST ID: ENST00000253934
  CDS Start-End: 452-1132
acagtcttagcagggcagcagccctgcagcctccccgctggcacggtcacaggccgctctgaggactggagggaccagccgcccacagagccccgagcccgtggtcccggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcttttcctaagttaaataaatgcaagcctctgaactctgtctataa

SEQ ID NO: 193880 - DNA, 1938 bp, Homo sapiens
  Payload ID: 18295
  Gene Name: transmembrane protein 204
  Uniprot ID: Q9BSN7
  ENST ID: ENST00000566264
  CDS Start-End: 704-1384
acatcctgttggtgtctggctgccgcggcagggccgctatttgttgcggttggctacgccttccagctcaccaaaaacagtctcaaaaacaaccatttcctctctgctgagagccagggaaggcgagctctgcgcacacgggcgtccctgcagcagccactctgctttccaggaccggccaactgccctggaggcatccacacaggggcccaggcagcacagaggagctgtgaacccgctccacaccggccaccctgcccggagcctggcactcacagcaggccggtgctaaggagtgtggcgcgggctcgactcccactgctgccggcctcccgagtgactctgttttccactgctgcaggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcttttcctaagttaaataaatgcaagcctctgaactctgtctataa

SEQ ID NO: 193881 - DNA, 1034 bp, Homo sapiens
  Payload ID: 18296
  Gene Name: transmembrane protein 205
  Uniprot ID: Q6UW68
  ENST ID: ENST00000354882
  CDS Start-End: 428-997
ggtttcctcggggctttcgggatcttcacctaatatccggtattattttatgagaggagtggtcttggctgtcagaactggatccctggggtgatatttgggaattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaa

SEQ ID NO: 193882 - DNA, 916 bp, Homo sapiens
  Payload ID: 18296
  Gene Name: transmembrane protein 205
  Uniprot ID: Q6UW68
  ENST ID: ENST00000447337
  CDS Start-End: 308-877
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 193883 - DNA, 688 bp, Homo sapiens
  Payload ID: 18296
  Gene Name: transmembrane protein 205
  Uniprot ID: Q6UW68
  ENST ID: ENST00000587948
  CDS Start-End: 83-652
aagcccgtggagggggcgggatcccaggggggtttctacgattagtcaatacccaggagggcgggatagaaaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaa

SEQ ID NO: 193884 - DNA, 628 bp, Homo sapiens
  Payload ID: 18296
  Gene Name: transmembrane protein 205
  ENST ID: ENST00000591677
  CDS Start-End: 308-628
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaa

SEQ ID NO: 193885 - DNA, 1003 bp, Homo sapiens
  Payload ID: 18296
  Gene Name: transmembrane protein 205
  Uniprot ID: Q6UW68
  ENST ID: ENST00000586956
  CDS Start-End: 397-966
cgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaa

SEQ ID NO: 193886 - DNA, 788 bp, Homo sapiens
  Payload ID: 18296
  Gene Name: transmembrane protein 205
  Uniprot ID: Q6UW68
  ENST ID: ENST00000589555
  CDS Start-End: 183-752
ggggaaacccacgaggggacgcggccgaggagggtcgctgtccacccgggggcgtgggagtgagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaa

SEQ ID NO: 193887 - DNA, 619 bp, Homo sapiens
  Payload ID: 18296
  Gene Name: transmembrane protein 205
  ENST ID: ENST00000590482
  CDS Start-End: 108-619
acagagaggggtgtggccggcattttagttccgcccctgccggagtagccgaaggcctcattggcgccttcacgcttcagctgcgcttagtagccgcggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctg

SEQ ID NO: 193888 - DNA, 563 bp, Homo sapiens
  Payload ID: 18296
  Gene Name: transmembrane protein 205
  ENST ID: ENST00000586701
  CDS Start-End: 204-563
atctacgacccgattggcttcgggctcagctgggaggcgggacgaattattggttgggggaaacccacgaggggacgcggccgaggagggtcgctgtccacccgggggcgtgggagtgaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggc

SEQ ID NO: 193889 - DNA, 840 bp, Homo sapiens
  Payload ID: 18296
  Gene Name: transmembrane protein 205
  Uniprot ID: Q6UW68
  ENST ID: ENST00000588560
  CDS Start-End: 241-810
gccgaggagggtcgctgtccacccgggggcgtgggagtgaggtaccagattcagcccatttggccccgacgcctctgttctcggaatccgggtgctgcggattgaggtcccggttcctaacgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttct

SEQ ID NO: 193890 - DNA, 428 bp, Homo sapiens
  Payload ID: 18296
  Gene Name: transmembrane protein 205
  ENST ID: ENST00000592952
  CDS Start-End: 58-428
ggacgcggccgaggagggtcgctgtccacccgggggcgtgggagtgaggactgcaagatggaggaaggcgggaacctaggaggcctgattaagatggtccatctactggtcttgtcaggtgcctggggcatgcaaatgtgggtgaccttcgtctcagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtc

SEQ ID NO: 193891 - DNA, 677 bp, Homo sapiens
  Payload ID: 18296
  Gene Name: transmembrane protein 205
  Uniprot ID: Q6UW68
  ENST ID: ENST00000586590
  CDS Start-End: 71-640
gaaacccacgaggggacgcggccgaggagggtcgctgtccacccgggggcgtgggagtgaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaa

SEQ ID NO: 193892 - DNA, 593 bp, Homo sapiens
  Payload ID: 18296
  Gene Name: transmembrane protein 205
  ENST ID: ENST00000586218
  CDS Start-End: 168-554
gaggtaccagattcagcccatttggccccgacgcctctgttctcggaatccgggtgctgcggattgaggtcccggttcctaacggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 193893 - DNA, 393 bp, Homo sapiens
  Payload ID: 18296
  Gene Name: transmembrane protein 205
  ENST ID: ENST00000590788
  CDS Start-End: 130-393
cacgaggggacgcggccgaggagggtcgctgtccacccgggggcgtgggagtgaggtaccagattcagcccatttggccccgacgcctctgttctcggaatccgggtgctgcggattgaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccag

SEQ ID NO: 193894 - DNA, 792 bp, Homo sapiens
  Payload ID: 18296
  Gene Name: transmembrane protein 205
  Uniprot ID: Q6UW68
  ENST ID: ENST00000593256
  CDS Start-End: 184-753
agctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 193895 - DNA, 2475 bp, Homo sapiens
  Payload ID: 18297
  Gene Name: transmembrane protein 206
  Uniprot ID: Q9H813
  ENST ID: ENST00000261455
  CDS Start-End: 139-1191
acgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctgactcccaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggcatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 193896 - DNA, 2119 bp, Homo sapiens
  Payload ID: 18297
  Gene Name: transmembrane protein 206
  Uniprot ID: Q9H813
  ENST ID: ENST00000535273
  CDS Start-End: 145-1380
atcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggaggctgtgcgtccagcgcttccttcaagcaagccctgcctcctcacttctccagctgtattagtgaaactgctctcctcctccgcctccacttctcggcccccaaaccttggtcatctttggcaaccgtcctcttctgtgcccctccatcgtgccgcctcattggccaaagtcaggcagttccagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtcttcctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaagg

SEQ ID NO: 193897 - DNA, 1448 bp, Homo sapiens
  Payload ID: 18298
  Gene Name: transmembrane protein 207
  Uniprot ID: Q6UWW9
  ENST ID: ENST00000354905
  CDS Start-End: 68-508
agttctgagaaagaaggaaataaacacaggcaccaaaccactatcctaagttgactgtcctttaaatatgtcaagatccagacttttcagtgtcacctcagcgatctcaacgatagggatcttgtgtttgccgctattccagttggtgctctcggacctaccatgcgaagaagatgaaatgtgtgtaaattataatgaccaacaccctaatggctggtatatctggatcctcctgctgctggttttggtggcagctcttctctgtggagctgtggtcctctgcctccagtgctggctgaggagaccccgaattgattctcacaggcgcaccatggcagtttttgctgttggagacttggactctatttatgggacagaagcagctgtgagtccaactgttggaattcaccttcaaactcaaacccctgacctatatcctgttcctgctccatgttttggccctttaggctccccacctccatatgaagaaattgtaaaaacaacctgattttaggtgtggattatcaatttaaagtattaacgacatctgtaattccaaaacatcaaatttaggaatagttatttcagttgttggaaatgtccagagatctattcatatagtctgaggaaggacaattcgacaaaagaatggatgttggaaaaaattttggtcatggagatgtttaaatagtaaagtagcaggcttttgatgtgtcactgctgtatcatacttttatgctacacaaccaaattaatgcttctccactagtatccaaacaggcaacaattaggtgctggaagtagtttccatcacatttaggactccactgcagtatacagcacaccattttctgctttaaactctttcctagcatggggtccataaaaattattataatttaacaatagcccaagccgagaatccaacatgtccagaaccagaaccagaaagatagtatttgaatgaaggtgaggggagagagtaggaaaaagaaaagtttggagttgaagggtaaaggataaatgaagaggaaaaggaaaagattacaagtctcagcaaaaacaagaggttttatgccccaacctgaagaggaagaaattgtagatagaaggtgaaggagattgctgaagatatagagcacatataatgccaacacggggagaaaagaaaagttccccttttacagtaatgaatgtggcctccatagtccatagtgtttctctggagcctcagggcttggcatttattgcagcatcatgctaagaaccttcggcataggtatctgttcccatgaggactgcagaagtagcaatgagacatcttcaagtggcattttggcagtggccatcagcagggggacagacaaaaacatccatcacagatgacatatgatcttcagctgacaaatttgttgaacaaaacaataaacatcaatagatatctaaaa

SEQ ID NO: 193898 - DNA, 793 bp, Homo sapiens
  Payload ID: 18299
  Gene Name: transmembrane protein 208
  Uniprot ID: Q9BTX3
  ENST ID: ENST00000304800
  CDS Start-End: 107-628
cgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 193899 - DNA, 832 bp, Homo sapiens
  Payload ID: 18299
  Gene Name: transmembrane protein 208
  ENST ID: ENST00000565201
  CDS Start-End: 52-474
cggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 193900 - DNA, 775 bp, Homo sapiens
  Payload ID: 18299
  Gene Name: transmembrane protein 208
  Uniprot ID: Q9BTX3
  ENST ID: ENST00000562235
  CDS Start-End: 63-365
cttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 193901 - DNA, 887 bp, Homo sapiens
  Payload ID: 18299
  Gene Name: transmembrane protein 208
  ENST ID: ENST00000563953
  CDS Start-End: 427-738
ggtctgcgccggaagtgcatgagctgccgatgtggtgcttagtgattgcggtttcggtcgctctcccgtgtttcccgggctgggtatttgcctcgcaccatggcggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaata

SEQ ID NO: 193902 - DNA, 518 bp, Homo sapiens
  Payload ID: 18299
  Gene Name: transmembrane protein 208
  ENST ID: ENST00000564087
  CDS Start-End: 7-117
cgcaccatggcgggcgagcaagaggcgattgatcctagctgcgggtgctggagagatggcgtcagccctaggcagaatggactggaggatgggtggacatcccagggattttgctaggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcaggg

SEQ ID NO: 193903 - DNA, 3545 bp, Homo sapiens
  Payload ID: 18300
  Gene Name: transmembrane protein 209
  Uniprot ID: Q96SK2
  ENST ID: ENST00000397622
  CDS Start-End: 124-1809
gagaagagactacctagttcttccggtaactttagagccgcttgccggtggcctcccgcttgagcttggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctgggattacaggcatgcaccaccacgcccagctaatttttgtatttttagtagagacagggtttcaccatgttggccaggctggtcccgaactcctgacctcaggtgatccacccacctcggcctcccaaagtgctgggattataggtgcgagccactgcgcccagcctcagttattttatttaacagtgtaagtacttagaaagtaagaaaattgctgatttagtttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatg

SEQ ID NO: 193904 - DNA, 1961 bp, Homo sapiens
  Payload ID: 18300
  Gene Name: transmembrane protein 209
  Uniprot ID: Q96SK2
  ENST ID: ENST00000473456
  CDS Start-End: 29-1588
gcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaa

SEQ ID NO: 193905 - DNA, 585 bp, Homo sapiens
  Payload ID: 18300
  Gene Name: transmembrane protein 209
  ENST ID: ENST00000471077
  CDS Start-End: 417-585
agaggacatggtgcgttttcggggtcgtgtttgtgcttcctgtcttggaatctacgcgggttgtgggagttccgcgcctgctgatctgtcctgggttcagccaagggggatgtggctaggcgttccgcctctctaggggaagggaagaaagaagcaatagggttgctgaagttcgtgcccaggagccggggagggaagctctggactgggaaattgggacgcgggggctgagtggcgcgaaagctattgctctgtcctctgtgggatacgactgcttgtcgctggaacaagttttgcacggtctgtaagagttgagcctagctgaagaaaggaggaattataaatcccaaatgtggaccaaaacaatgcacgttttcccctctctccctcttactccgctcaccaccccatcataaatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatg

SEQ ID NO: 193906 - DNA, 2322 bp, Homo sapiens
  Payload ID: 18300
  Gene Name: transmembrane protein 209
  Uniprot ID: Q96SK2
  ENST ID: ENST00000462753
  CDS Start-End: 267-1949
gcttcctgtcttggaatctacgcgggttgtgggagttccgcgcctgctgatctgtcctgggttcagccaagggggatgtggctaggcgttccgcctctctaggggaagggaagaaagaagcaatagggttgctgaagttcgtgcccaggagccggggagggaagctctggactgggaaattgggacgcgggggctgagtggcgcgaaagctattgctctgtcctctgtgggatacgactgcttgtcgctggaacaagttttgcacgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaa

SEQ ID NO: 193907 - DNA, 571 bp, Homo sapiens
  Payload ID: 18300
  Gene Name: transmembrane protein 209
  ENST ID: ENST00000471985
  CDS Start-End: 3-571
aaatgcttcttggacttctaagtttgtggaagggtctcactctgtcgcccagactggaatgcagtggcaccatcttggctcaccgcaacctcggcttcccaggctcaagtgattctcctgcctcagcctccagaatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttc

SEQ ID NO: 193908 - DNA, 566 bp, Homo sapiens
  Payload ID: 18301
  Gene Name: transmembrane protein 210
  ENST ID: ENST00000535352
  CDS Start-End: 20-181
agtggggccagggctggacatggcccccggtccctggcctgtgtcctgcctgcgtggtggccccttgggcctcacatatttgtcccttctgctcatccctgctgcaggtgcctcctcctgcccccgcactccactcccagccatggctccccttccccaggcaagctggaacctactgtgaatgcagccttggcctcagccgcgaggccctcatcgccctccttgtggtgctggcgggcatcagtgccagctgcttctgtgccctcgtcatcgtggcaattggtgtcttgcgggccaagggtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtatttagtg

SEQ ID NO: 193909 - DNA, 873 bp, Homo sapiens
  Payload ID: 18301
  Gene Name: transmembrane protein 210
  Uniprot ID: A6NLX4
  ENST ID: ENST00000413619
  CDS Start-End: 383-826
gaaggatttggctgggcgcagtggctcacacctgtaatcccagcactttgagaggccgaggcgagcggatcacaaggtcaggagatcgagaccatcctggctaacacggtgaaaccactgaaggactgcccgtaagaccaggccagccccactgctgcctctgcctcagagctggcctgagctggctgggctctcaggcctctgcccaccctacctgtcccattcccagagctgcttggccatggctccttgaattgcggtgcccaagggcaaatgacacactggcattgtgagcccccccacccccacctcacagtcctactgtgaagtcagcaccttccaacagttccgtcagaggtgtgcagtggggccagggctggacatggcccccggtccctggcctgtgtcctgcctgcgtggtggccccttgggcctcacatatttgtcccttctgctcatccctgctgcagctggaacctactgtgaatgcagccttggcctcagccgcgaggccctcatcgccctccttgtggtgctggcgggcatcagtgccagctgcttctgtgccctcgtcatcgtggcaattggtgtcttgcgggccaagggtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtatttagtggc

SEQ ID NO: 193910 - DNA, 866 bp, Homo sapiens
  Payload ID: 18302
  Gene Name: transmembrane protein 211
  ENST ID: ENST00000407886
  CDS Start-End: 254-643
cattgttctacaagctaaattattccttcaaaggagaggagaattgtataaggtcacagacgtggatccaaagccggagcctgagcagaggtggccacgctggagggtcttgacctaaagtgtgaccccgaccttctcctttggcatcctcacctactgctcctggcctcagggcaacagttggaaccagagctgcgtgaccttcagttccctggaggatattcctgactttgcctggaaggtctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgctgtgtgacttcaggcaagccactttacctctctggaacagttttttcttctggaaaatgaaagttgaaatcatacctacctcataaggttgttctgagaattcactggagatgctctgtgtaaataaagca

SEQ ID NO: 193911 - DNA, 695 bp, Homo sapiens
  Payload ID: 18302
  Gene Name: transmembrane protein 211
  Uniprot ID: Q6ICI0
  ENST ID: ENST00000423535
  CDS Start-End: 1-603
atgttgagcagtgtgtgggtagctctggggctctctctgacctgcacctcagccttcagcctcatctcccctgcctggttccagaccccgaccttctcctttggcatcctcacctactgctcctggcctcagggcaacagttggaaccagagctgcgtgaccttcagttccctggaggatattcctgactttgcctggaaggtctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgc

SEQ ID NO: 193912 - DNA, 1881 bp, Homo sapiens
  Payload ID: 18303
  Gene Name: transmembrane protein 212
  Uniprot ID: A6NML5
  ENST ID: ENST00000334567
  CDS Start-End: 36-620
atctttgagaccaaggcctcaagccaccaaggaaaatgaagggcctctaccaggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaagaattggaaaaaactaaagttcatatgggaccaaaaaagagcccgcatacccaagacaatcctaagcaaaaagaacaaagctggaggcatcacactacctgacttcaaactattctacaaggctacagttaccaaaacagcatggtactggtaccaaaacagatatatagaccaatggaacagaacagaggcctcagaaataacaccacacatatacaaccatctgatctttgacaaacctgacaaaaacaagaaatggggaaaggattccctttttaataaatggtgctgggaaaactggttagccatatgtagaaagctgaaactggatcccttccttacaccttatataaaaattaactcaagatggattaaagacttaaatgtaagacctaaaaccataaaaaccctagaagaaaacctaggcaataccattcaggacataggcatgggcaaagacttcatgactaaaacaccaaaagcaatggcaacaaaagccaaaatagacaaatcgtatctaattaaactaaagggcttctgcatggcaaaagaaactatcatcagagtgaacaggcaacctacagaacgggagaaaattttttcaatctacccatctgacaaacagctaatatccagaatctacaaagaacttaaacaaatttacaagaaaaaaacaaacaaccacatcaaaaagtaggcaaaggacatggacacttctcaaaagaagacatttatgaagccaacagacacacataatcccaaatcatgctactataaagacacatgcacacgtatgtttattgcggcactattcacaatagtaaagacttggaaccaacccaaatatccatcaatgatagattggattaagaaaatgtggcacatatacaccatggaatactacgcagccataaaaaaggatgagttcatgtcctttgcagggacatagatgaagctggaaaccatcattctccgcaaactgtcacaaggacagaaaaccaaacaccacatgttctcactcataggtgggaattgaacaatgggaacacttggacacagggtggggaacatcacacactggggcctttcagtgggtgggaggctgggggagggatagcattaggagaaattcctaatgtagatgatgagttgatgggtgtggcaaaccaacatggcacatatatacctatgcaacaaacctgcatgttgtgcacatgtaccctagaacttagagtataataaaaaaaaagaaaacagtg

SEQ ID NO: 193913 - DNA, 723 bp, Homo sapiens
  Payload ID: 18303
  Gene Name: transmembrane protein 212
  ENST ID: ENST00000450693
  CDS Start-End: 1-453
gcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaaggtaaaatggtctggggatagaaaaggcctgggaccagaatataaaagcacacagattaatagaattataaaatttaagatgtttaaacaagctttatataaggtagttgaactcctttacctaaatgtcttattaaaatgggtactgcatctgactgggatgtttcccctttctagtactatgaagctgaaggcatgtaaatctgctcttttaggaaatgttaattaaacatgctaaatgggaactagtaaaatcacctaagcccac

SEQ ID NO: 193914 - DNA, 864 bp, Homo sapiens
  Payload ID: 18303
  Gene Name: transmembrane protein 212
  ENST ID: ENST00000420375
  CDS Start-End: 1-568
ggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataaaagtttggacctgattaaagaaggacaacaaaggccaatttgccatcaccaaaggagcagcttgacctggagggatgaggcctggaggccgacagcaggactccgtcagtgattctttcagctcttgaaaatgtccaagaaagacactttctctcacctttttggagcctctagcctgccctgggaagcctggtggactggtgctgagaagagaccacggcccagttggagtcccactctgtcgcccaggctggagtgcagtggcacgatctcagctcactgcaacctccacctcc

SEQ ID NO: 193915 - DNA, 585 bp, Homo sapiens
  Payload ID: 18303
  Gene Name: transmembrane protein 212
  Uniprot ID: A6NML5
  ENST ID: ENST00000619900
  CDS Start-End: 1-585
atgaagggcctctaccaggctgctggccggattcttgttactctggggatcctcagtgtatgctctggagttattgctttctttcctgtcttttcttacaagccttggttcacaggatggagtgttcgaattgcttgtcctatctggaatggagctttggccatcacaactggtgtgcttctactgttggcttacagagagtggacccagaggtacctgggggaagctactttcacctttgtgattctgagcattatgggatgtccacttcattttgcaatagccttggaatctgctctcctgggcccatattgcttctattcattttcagggattgcagggactaattaccttggctatgcagttacctttccttatccatatgcaaaattcccattagcctgtgtggacccaccacactacgaagagtaccacctgacacttcaagccctagacctgtgcctaagctttaccctactctgtacatccttgacagtgttcatcaaactttctgcaagacttatccagaatggacacataaacatgcaactccctgctgggaacccaaaccctttttcaccataa

SEQ ID NO: 193916 - DNA, 1153 bp, Homo sapiens
  Payload ID: 18304
  Gene Name: transmembrane protein 213
  Uniprot ID: A2RRL7
  ENST ID: ENST00000397602
  CDS Start-End: 154-474
atggtgtttcccccaaacacccagcataagttcacctctggcagagttgctttccagctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagcaagcagcagcaacagctcaagcttgaccgctcaccacccagaccctgggaccctggagcagtgcctcaacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgcataaccttctcaccaaaaccaggttatctgcttctgtccctggcttgagtcctgggcttaactgtcatttcagaatctgagaatcagtcaggtatggtggctcatgcctgtaatcccagcactttgggaggcagaggtgggcagatcactcaaggtcaggagttccagatcagcctggccaacatggtgaaaccctgtctctactaaaaatacaaaaattagccaggtgtggtggtgcacacctgtaatcccagctacttgggaggccgaggcaggagaatctcttgaacctcggaggcggaggttgcagtgagccaagatcatgccactgcactcca

SEQ ID NO: 193917 - DNA, 4167 bp, Homo sapiens
  Payload ID: 18304
  Gene Name: transmembrane protein 213
  Uniprot ID: A2RRL7
  ENST ID: ENST00000442682
  CDS Start-End: 154-477
atggtgtttcccccaaacacccagcataagttcacctctggcagagttgctttccagctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagaagcaagcagcagcaacagctcaagcttgaccgctcaccacccagaccctgggaccctggagcagtgcctcaacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgcataaccttctcaccaaaaccaggttatctgcttctgtccctggcttgagtcctgggcttaactgtcatttcagaatctgagaatcagtcaggtatggtggctcatgcctgtaatcccagcactttgggaggcagaggtgggcagatcactcaaggtcaggagttccagatcagcctggccaacatggtgaaaccctgtctctactaaaaatacaaaaattagccaggtgtggtggtgcacacctgtaatcccagctacttgggaggccgaggcaggagaatctcttgaacctcggaggcggaggttgcagtgagccaagatcatgccactgcactccagcctgggcggcagagcaagactctgtatcagaaaaaaaaaaaaaaaaaagaatgtgaggatcaggtgggcatggtggctcatgcctgtaatcccagcactttgagagactgagacaggaggatcactttagcccaggaattcgagaccagcctgggcaagatggcaagaccttgtttctgtttaaaaactttttaaagttaaaaataaaaatgtgagaatccccttgacactcccaccatcttcacccccacctcaggtccttctccagctctccttctggcttcatcctgtcttccacggctctcctgtcccacctattctccctgccggtgcccaagttttagccttcactgccttcccctagaacacgccagggatattgcattctgtcctcactgtcttgaggatcttcctccccggctcatcactccccatgggcagctgccagggtaggcgctgtcaccttctgttgacaacagtcagtagctcctaaggactaaaactgttcagcccagcattcagctctttggaggagtccatctgtcccccagcacatccaggagtaaggattccgactggtccactcctcatcctggtgtcttcagcttctctgctgccatgttctttgctgggatggctgcttcccaactccacctccagaatcaaggatattcctccaagcccagctcgaatgcttgatctgcctggagccttcctggtcatccttgggtgacctggagctggtgctgttagagcacttctgctctgccctgatgtgcagttgttgtgaatgggccactccatagtttatccttcctcacacccctggggcatagtaccctattcaagtttgtccaatgagtgcatgggtgaattaatgaatgaatgaacaaatgagtctttgccctagacaacttaaggtcctcactctgcattaggagcctccatttttctccagatggttgaaataaccagcctctgaaggagccaatggtttggtcactgctctctcagcaaattacagtcactgtcacttagcatggagagtggacgttgcacatcactgtgaaaccttgcagaggaggagagggcaggttcatcagaagaaagaaaggacaaaatgactccttatgaagcattttgtgccttctgtgagaaaacatgtatttagatcagataaactctagtcaaaatacaaaaaggaaaaatgaaagacctctgaaataggaacaatctcttgaagaggcaaatgactcaaaactgctcagtggctctttcagaaaatctaagtaaagttccctgacaacagaaactgaagagattgcctggttcatcttgtagtcttccaaaacagcagataatttctgaatctcagatgttgaatcagtgcaacgggatggatttcttgttcctaagtgttaaatgatcacatacataaaagagtctgagcctgagcaacataatgagaccctgtctctacaaaaaaaaaaaaaagattagccaggcgtggtggtgcacactgatagtcccagctactcaggaggctgagggaggcggatcacttgagctagagagttcaaagctgcagtgagccatgtttgtgccactgcactccagcctgggcaacaaagtgagaccctgtctggaaaaaaaaaaaaaaaaagcgtctgcataattcctggtgcattttgtggatatacaatatgagtatgtgttccatgttttcagaaattcaaaggaagcgtttccacaatatgtgacggtttatttcccaagagatgaaaagattcattaaggtgcatgctttgatttaacatctgcaaacatttaaaaaatataacagtgtgtgacgtagcagtgagagtactatctttttttaaaaagggaaattaagatttatttctggccaatgtgaacagaaataagtcactttatctcactgagcaccaattttacacgtggaaaatagaagaattggaccaaatcagcagtttcaagctgagttgcaaaagttcatggaaccatttcagtcgcttcatggaatcggggtaggcatgaggcccgttgttctttcaacctgagccgcatggctcttgtgtctttaaaccttgtggtaggatttttttttttttctgctttaataagtgaagggtcagggcaccagttggtgtctgagatgccctccagtctggggaaccccgtagatgcttagactactttgaactgaagtatgtgcagtctgccatctcacattaaaatgtaggcattttgtcaattgcttttctttcatctgcacaagaggaaggagagaacgaatcaatacaaccactcttttccttgagactgcaaagaaaatggttctatagtttgatggttctacttcccagatgctacctctcagatttattctcaacagaaaattttttgattacagcagaccagatctttatctgtcaataagttaaaaaagataatctgggctggatgtggtggctcactcctgtaattccagcacttcgggaggccaagacaggaggattgcttgagcccaggaatttgagaccagcctgggcaacatggcgaaaccccacctctacaaaaaaatacaaaaaaattatttgggactggtggcgcatgcctgtggtcccagctactcgggaggctgaggtgggaagatcatttgagcccaggaggttgaggctgcagtgagctatgatcttgccactgcactccagcctgggtgacagagtgagaccttgcctcaaaaagaaaaaaataaagaaaagaaaatctgaaagggaaagcaggcatcaacttccagggatctaataacttcctaacttaaagcaacagaacttacctaacttttggacttttcattttaaaactttgcctctagcagtggacactgtcctcaacacagctacagtttatgtaacacagagtccatattatatggggcatgtctgtatcaaaatgtcatatgtagaaataaagtattaaatattaa

SEQ ID NO: 193918 - DNA, 572 bp, Homo sapiens
  Payload ID: 18304
  Gene Name: transmembrane protein 213
  Uniprot ID: A2RRL7
  ENST ID: ENST00000458494
  CDS Start-End: 99-350
agctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcc

SEQ ID NO: 193919 - DNA, 480 bp, Homo sapiens
  Payload ID: 18304
  Gene Name: transmembrane protein 213
  Uniprot ID: A2RRL7
  ENST ID: ENST00000413208
  CDS Start-End: 94-411
ctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagaagcaagcagcagcaacagctcaagcttgaccgctcaccacccagaccctgggaccctggagcagtgcctcagaagcggatacttggcaaatctgcgaggcgaggccgatcagctgtggaagttctgcacggtgctctgtttctgggagagccggaggagctcctcgcggattgctttgatgagagaggccgaggagtggccaggctggaggtcttccgtggagctggtggggtaacccagcccagggccctgcagtccccggtgggggaggttcccggaaggagctgagggctccctgcctgaa

SEQ ID NO: 193920 - DNA, 2990 bp, Homo sapiens
  Payload ID: 18305
  Gene Name: transmembrane protein 214
  Uniprot ID: Q6NUQ4
  ENST ID: ENST00000238788
  CDS Start-End: 63-2132
gcggcgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctag

SEQ ID NO: 193921 - DNA, 2700 bp, Homo sapiens
  Payload ID: 18305
  Gene Name: transmembrane protein 214
  Uniprot ID: Q6NUQ4
  ENST ID: ENST00000321326
  CDS Start-End: 63-2132
gcggcgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttcta

SEQ ID NO: 193922 - DNA, 2830 bp, Homo sapiens
  Payload ID: 18305
  Gene Name: transmembrane protein 214
  Uniprot ID: Q6NUQ4
  ENST ID: ENST00000404032
  CDS Start-End: 40-1974
aaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttct

SEQ ID NO: 193923 - DNA, 834 bp, Homo sapiens
  Payload ID: 18305
  Gene Name: transmembrane protein 214
  ENST ID: ENST00000434544
  CDS Start-End: 1-421
gtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtgg

SEQ ID NO: 193924 - DNA, 919 bp, Homo sapiens
  Payload ID: 18305
  Gene Name: transmembrane protein 214
  ENST ID: ENST00000444135
  CDS Start-End: 1-919
aagagacagcacattcagggtggatgtgcggcctggatggccttgcttacgggaaggggatcacctcttagcactccccgcctctgccagccccatgcccccagcagcctctccctctgtcgtgctgtgcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcat

SEQ ID NO: 193925 - DNA, 740 bp, Homo sapiens
  Payload ID: 18305
  Gene Name: transmembrane protein 214
  ENST ID: ENST00000425720
  CDS Start-End: 1-740
tggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtc

SEQ ID NO: 193926 - DNA, 1480 bp, Homo sapiens
  Payload ID: 18305
  Gene Name: transmembrane protein 214
  ENST ID: ENST00000435172
  CDS Start-End: 1-678
agccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagagcccattctgaggcttttccttagctccctgttgacagctgcctgccccgctcactcgagcttcaccctcagaagatggatcccaagagacagcacattcagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccac

SEQ ID NO: 193927 - DNA, 3581 bp, Homo sapiens
  Payload ID: 18306
  Gene Name: transmembrane protein 215
  Uniprot ID: Q68D42
  ENST ID: ENST00000342743
  CDS Start-End: 366-1073
gatgtaacaaggccaggctcgcgccgcgtcccctctttcccagactcagtgctccctcctcctcccgcgccccgcgctctgcgcgctgagctggcgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgctgtgggggcttctgaggagacagcctggcttctttccctacttcctggagagggcaggaaacctcagaatagaggaacgctgctccctggtcagcaagcagcccccaacctggatggagtgaaacatgcggcctgatgacattaacccgaggactgggctggtggtggccctggtcagtgtcttcctcgtctttggtttcatgttcaccgtctctgggatgaaaggggagactttgggaaacatccccctcctggccatcgggccagccatctgcctaccaggcatcgcagccattgccctggccaggaaaaccgagggatgcaccaagtggccagagaacgagctgctgtgggtccgcaaattgccctgcttccggaaacccaaagacaaggaggtggtagagctgctgaggaccccttcagacctagaatccggcaaggggagctcagatgagctggctaagaaggcgggcctcagggggaagcctcccccacaaagccagggtgaggtgtccgtggccagctccatcaacagccccacacccacggaggaaggagaatgccagagcctcgtccagaatgggcatcaggaggagacgtccagatacctggacggctactgcccctcgggcagttccctcacctacagtgccttggacgtcaagtgctcagcaagggacagatctgagtgccctgagcctgaggatagcatcttctttgtgccccaggacagtatcatcgtttgctcctacaagcagaacagcccgtatgacagatactgttgttatatcaatcagatacaaggcaggtgggaccacgagaccatcgtctaatctctgcctacaaaggtggctggattgatagaatatgactaagcccagctccccgtggaagcaaattgctctgcttggagagccttcacactgttagaaattgacctggtatgtgatgggtgtgataacctctggtacccgagagtcatgtaaataggcatgttggggacacattttagggaagggcgatgagggttaaggacactggaagaggcagtgggtaggaaaggaagctactccagttgcttcttaacaatttacacaatgttaaatgttttgtaaaataacccaaaaagtgctatccagaaccagctgagagcaagataaatctagagtgggctgcagatgtgaggcatcaaatgatgcatgagctgaccacagggaaactgagctgctttatgtttgaataagttgaaaataaaattaatgatccgttatataaagtaatttttgcctggttaaaagcttatcacacttggtatttgctgaaagaaaaaaaaatcaagatacaagagttaaaccctccttagatgggatggtttttgggaaaagggtagttaaagagagttggattatgtaactgagtcttgtggcattattgtctgacaagatcatggtctctaataaagtaaaataagtgtgagcagctatgtgaaaagttaacatttttagatggctatgttacttcttaaactcttcgtttaaatccatttattgcatctttatctgaaatgggttttttctaaacatttactatcattcatgtattatttccttaccaggtgcaacattatttgaaatgatactttcatagattggaatttgttttcatcaagacaaaatgaattttacatatatatccaagtctttaacattggcagacatgtactgataattaccattcctacataccttttaaaatctgaaaactataaagtctacacattagccttgaacattgcacataatttgtatgaaatgcaatggttaaacctttggaagtgtcattatttgtacatttgttcaactcctctcacagactgtaaatgccagtgaaacaagaactcatctactaaatttaactgaagcctagattttattaagctcacctgatcagtgaacattacatgataaaagtctctttatttcatacatttttgctgctgaggaaaacaacaaatcacaatgatatcctaaaatgtgctttctatttcacttgctcaactgcaatagataagaaggctatcaagcagaatgccatttgatccccggtgaagaaaaatatgaattatatataggaatggtgatagagttcatcttgaagatcagaagtattttgtatccttcaaagaatgatcattttaagtgatcatatagtcttagtcactttctcccaaaaggggaattgaggacaaaaatttgggcatatatgttttgtgtatttcaattccaactctgcaattctttcttaagtatagcaattgttctgtcttaagaatcatggtatttttaaaaaatcataattttcaagtcaagttcaagatcaaaaatatgtaattattttagtagggcttaaatatcagaaatgagatgcatgatcttgggcaaattttatcttcttacacctgagtttcctactctgtgaagggagggggaactgatttacacttgattatttctatcattcattttcagtgtaaatattctatggtgttatgtcaaaggcattttatatattgccaggaaatgagttacagcaaaatgcatgccaaagttatgaaatttatgataattatgtgacatacattgcacagctactactcaaaaaagaattttgtagatgtatgaaagcagattattcaacacaatgcattcctgagaataaaatgaacataatcagagtaaaatatttttgaggagaaaacttaaaatgttggtataactcaaagtaatctaatacacaaccttgcactaaatgtgattgacatttggatttgggatggggagagatagtttcctaaaatcacagtaacttttaataattgtaatgcattttgaaaacagagaatcatatttttataatggtgagaactatgcaataactctttaggaatgaaaacttcctttaagaagtttgccaccgttagagatgaggagatagtgagacagagagatgttcacagagactcagcaaatcttagacaataatgctgcaattttctgaaagaagatgcttgcagtgtcaggtatggtttgggggttggaaaagttacttttctgatttcttggaaccatttaaaactcctttatatcattctgtctctttccaaattgagggtcaactactagtttagagatataaggtattttatcttgttttcaagttctacttcagaagaaaacctatttcatgtttcttctcccattacctacttaagatacttaaggtatttaagtatgcatttgaggaaatattttcctgtgctaaaataaaggtttgcaaatgtt

SEQ ID NO: 193928 - DNA, 1306 bp, Homo sapiens
  Payload ID: 18307
  Gene Name: transmembrane protein 216
  Uniprot ID: Q9P0N5
  ENST ID: ENST00000334888
  CDS Start-End: 273-719
acttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccgctcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccagtatggacaggatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatgtattttctgttgtgggggttgcagccttt

SEQ ID NO: 193929 - DNA, 908 bp, Homo sapiens
  Payload ID: 18307
  Gene Name: transmembrane protein 216
  ENST ID: ENST00000398979
  CDS Start-End: 437-691
ccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtgagattccggaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccgctcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccaggatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactcc

SEQ ID NO: 193930 - DNA, 1958 bp, Homo sapiens
  Payload ID: 18307
  Gene Name: transmembrane protein 216
  Uniprot ID: Q9P0N5
  ENST ID: ENST00000515837
  CDS Start-End: 946-1383
cagttttctgtttttttttttttttgagacagagtctcactgtcgcccaggctggagtgcggtggcgcgatctcagctcactgcaacctccgcctcccgggttcgagcgattctcctacctcagcctcccaagtagctgtaactactggcgcgcgccagtacgcccggctaatttttgtatttttagtagagacggggtttcgccatgttggccaggctgatttcgaactcctgacctcaggtgatccatcacctcggcctcccaaagtgctgggattacaggcgtgagccactaagcccggccagcaacacgcttttaccgctgcaaatccggatcaggcaggctttgaagcccagctcacaggccgtctcttggaaactaacttagatttccacctgggagcactttgtcctctcagctcccactgcaccactttatggatcgcgtggtgactcgtttcattttatttatgtgtgttcctggaaaggacgctctatttccttcgtgtctctacctggtaggtaaatcggccgcagaaaagaccaatgctaactccaccctgcatttgcagagatccgtcgctcacaccttttcttgtcttccgttgaaaaaagagaatcgtgggagtaggacctatttgccaatctcctggtaacactatcacaactggccacttccgcccaacgcccggtagtctgagagcctccaaggtcctcccccgcacccctgaggtcctgcagacgacggcgtcgtgggtggtcaccgttatcccttaggtctggagaggggacatccgagcgagggccacttgcggccaggcccgagctcgtccagctccgggtgaccacagagtgccgcgggcgggcagaggggccggaaacccaggccgcttcgtccctgtttccggcagcgccgcgctgctccgggagccgctgtggcagcgtatgctgccacggggactgaagatggcgccgcgaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccgctcagtattagcgtggccttgaccttcccatctgccatgatggcctcctattacctgctgctgcagacctacgtactccgcctggaagccatcatgaatggcatcttgctcttcttctgtggctcagagcttttacttgaggtgctcaccttggctgctttctccaggatttgaagtacagaatttcagccagcagcccatcaggctgacaccacacatattgcttctggtactttagccacaccagtgagaattggtggggcaagttgtcctgagaaaggctgtgtggcttttcttcagcacagacatttgggcaagcaactcagcataaggccagtgggtaccatcttctaaaccaggaccatcagcccaagagactcttctacactccagtatagggaggggcaaggttattcccatcctgccccttctcagaaccagtcccctgctgacctcaagttctcctccttgatcaccgtggccagagcatctcgtgtggaccatctaggctccttgggcttcaagcaggacctgagccacatgctccctgtacgagctgtgctatacctgtcccacatgagcacggagagcctcatgttggtgggtttccagagtgatgtgaaagcctctcaccccaatcctcggagactgagttccacaacttttttagtagctcatagtgttatttttctactctcttcatgaaactaactttattttataataaatatgtattttctgttgtgggg

SEQ ID NO: 193931 - DNA, 1546 bp, Homo sapiens
  Payload ID: 18308
  Gene Name: transmembrane protein 217
  Uniprot ID: Q8N7C4
  ENST ID: ENST00000336655
  CDS Start-End: 41-730
agttcctacccgcgagagggaagaagcaggaggtctcagcatgaaacagcagcagtggtgtgggatgactgccaaaatgggcaccgtgttgtcaggggtcttcaccatcatggccgtagacatgtatctcatctttgaacagaagcacctagggaatggcagttgcactgagatcacaccaaagtacaggggtgcaagtaacatcataaataacttcatcatctgctggagttttaaaatcgtcctcttcctgtctttcatcaccatcctcatcagctgcttcctcctgtactcagtgtatgcccagatcttcaggggcctggtcatctacattgtctggatttttttctatgaaactgcaaacgtcgtaatacaaatcctcaccaacaatgactttgacattaaagaggtcagaatcatgcgctggtttggcttggtgtctcgtacagtcatgcactgtttctggatgttctttgtcatcaactatgcccacataacctacaaaaaccggagccagggcaatataatttcctacaagagacgaatttctacagcggagattctccacagcagaaataaaagattatcaatttcgagtgggttcagtggctcacacctggaatcccagtactttgagaggcagagcttccacactagcatatttacctgtctgtctccagtgccaagctcagcccccagcacctgtagatacacaatagatgtctgctgagaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcttttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaactcatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatc

SEQ ID NO: 193932 - DNA, 1489 bp, Homo sapiens
  Payload ID: 18308
  Gene Name: transmembrane protein 217
  Uniprot ID: Q8N7C4
  ENST ID: ENST00000356757
  CDS Start-End: 68-703
ttggacgagccgagaggcggggctcaaagttcctacccgcgagagggaagaagcaggaggtctcagcatgaaacagcagcagtggtgtgggatgactgccaaaatgggcaccgtgttgtcaggggtcttcaccatcatggccgtagacatgtatctcatctttgaacagaagcacctagggaatggcagttgcactgagatcacaccaaagtacaggggtgcaagtaacatcataaataacttcatcatctgctggagttttaaaatcgtcctcttcctgtctttcatcaccatcctcatcagctgcttcctcctgtactcagtgtatgcccagatcttcaggggcctggtcatctacattgtctggatttttttctatgaaactgcaaacgtcgtaatacaaatcctcaccaacaatgactttgacattaaagaggtcagaatcatgcgctggtttggcttggtgtctcgtacagtcatgcactgtttctggatgttctttgtcatcaactatgcccacataacctacaaaaaccggagccagggcaatataatttcctacaagagacgaatttctacagcggagattctccacagcagaaataaaagattatcaatttcgagtgggttcagtggctcacacctggaatcccagtactttgagaggcagaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcttttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaactcatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatct

SEQ ID NO: 193933 - DNA, 1034 bp, Homo sapiens
  Payload ID: 18309
  Gene Name: transmembrane protein 218
  Uniprot ID: A2RU14
  ENST ID: ENST00000279968
  CDS Start-End: 325-672
tagagcctgggggagagtggatccaggtgaagggggcagaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggctttctgtatttgtctgaatgctttcacgggagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttct

SEQ ID NO: 193934 - DNA, 873 bp, Homo sapiens
  Payload ID: 18309
  Gene Name: transmembrane protein 218
  ENST ID: ENST00000533273
  CDS Start-End: 663-873
ctaagtaaaccagagccccgtgggctggaacgcgccggaatctgaggtgtgagtagagcctgggggagagtggatccaggtgaagggggcagaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttatattcagagagggttcagctttctcccgtgggctgggggaagaggtcaaagtagaactcaggtaccaaatttgaaaggaaacactcagaaaaaacttctgagcgcagagcggaaaacaccctctcagtccccaccaaagagaaaggctttgggttctaaatttccagtttccattaagggactctgggactggacatttctgaaaattaatgacctgtactgagtaatcctcctaacacactgatcatcaaaaaataacctgtaatgagtttaggctttctgtatttgtctgaatgctttcacgggagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagtta

SEQ ID NO: 193935 - DNA, 734 bp, Homo sapiens
  Payload ID: 18309
  Gene Name: transmembrane protein 218
  ENST ID: ENST00000529609
  CDS Start-End: 270-407
agagccccgtgggctggaacgcgccggaatctgaggtgtgagtagagcctgggggagagtggatccaggtgaagggggcagaggactgggagttttcatcctcttgaataagaactcgacaacagagtgggaactttctgtcttgtgatccattgcctggctttctgtatttgtctgaatgctttcacgggagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaa

SEQ ID NO: 193936 - DNA, 954 bp, Homo sapiens
  Payload ID: 18309
  Gene Name: transmembrane protein 218
  ENST ID: ENST00000532156
  CDS Start-End: 291-428
tagagcctgggggagagtggatccaggtgaagggggcagaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctt

SEQ ID NO: 193937 - DNA, 848 bp, Homo sapiens
  Payload ID: 18309
  Gene Name: transmembrane protein 218
  Uniprot ID: A2RU14
  ENST ID: ENST00000529583
  CDS Start-End: 381-728
aacgcgccggaatctgaggtgtgagtagagcctgggggagagtggatccaggtgaagggggcagagggcttgagtcagtgtgaaaatcgggggatgggtgagatatctccctccagcagcagcacttaggccacattaccctctgaggaatccacatttgtcttagatagttacctgtgcagggatcagtccatttattcctattttctctgacagctggatgaaagggactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatc

SEQ ID NO: 193938 - DNA, 910 bp, Homo sapiens
  Payload ID: 18309
  Gene Name: transmembrane protein 218
  ENST ID: ENST00000524373
  CDS Start-End: 699-910
gggctggaacgcgccggaatctgaggtggcttgagtcagtgtgaaaatcgggggatgggtgagatatctccctccagcagcagcacttaggccacattaccctctgaggaatccacatttgtcttagatagactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggtagggttttatattcagagagggttcagctttctcccgtgggctgggggaagaggtcaaagtagaactcaggtaccaaatttgaaaggaaacactcagaaaaaacttctgagcgcagagcggaaaacaccctctcagtccccaccaaagagaaaggctttgggttctaaatttccagtttccattaagggactctgggactggacatttctgaaaattaatgacctgtactgagtaatcctcctaacacactgatcatcaaaaaataacctgtaatgagtttaggctttctgtatttgtctgaatgctttcacgggagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaa

SEQ ID NO: 193939 - DNA, 1103 bp, Homo sapiens
  Payload ID: 18309
  Gene Name: transmembrane protein 218
  Uniprot ID: A2RU14
  ENST ID: ENST00000532407
  CDS Start-End: 394-741
tagagcctgggggagagtggatccaggtgaagggggcagagggcttgagtcagtgtgaaaatcgggggatgggtgagatatctccctccagcagcagcacttaggccacattaccctctgaggaatccacatttgtcttagatagactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttct

SEQ ID NO: 193940 - DNA, 812 bp, Homo sapiens
  Payload ID: 18309
  Gene Name: transmembrane protein 218
  Uniprot ID: A2RU14
  ENST ID: ENST00000527766
  CDS Start-End: 198-545
ccggaatctgaggtgtgagtagagcctgggggagagtggatccaggtgaagggggcagaggactgggagttttcatcctcttgaataagaactcgacaacagagtgggaactttctgtcttgtgatccattgcctgcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaa

SEQ ID NO: 193941 - DNA, 584 bp, Homo sapiens
  Payload ID: 18309
  Gene Name: transmembrane protein 218
  ENST ID: ENST00000529530
  CDS Start-End: 427-584
aacccaccgcgctcggcgttgccgggagccgcgctaggcgtaagctaatgaggaagaagttggccgttgaaagagcaacgctgattagtgaatcttaaatcacctaaatgaaagcccacttgtgattcgccctaagtaaaccagagccccgtgggctggaacgcgccggaatctgaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagt

SEQ ID NO: 193942 - DNA, 706 bp, Homo sapiens
  Payload ID: 18309
  Gene Name: transmembrane protein 218
  Uniprot ID: A2RU14
  ENST ID: ENST00000527271
  CDS Start-End: 283-630
gtgggctggaacgcgccggaatctgagggcttgagtcagtgtgaaaatcgggggatgggtgagatatctccctccagcagcagcacttaggccacattaccctctgaggaatccacatttgtcttagatagactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcaga

SEQ ID NO: 193943 - DNA, 972 bp, Homo sapiens
  Payload ID: 18309
  Gene Name: transmembrane protein 218
  Uniprot ID: A2RU14
  ENST ID: ENST00000526175
  CDS Start-End: 345-692
cccgtgggctggaacgcgccggaatctgagggcttgagtcagtgtgaaaatcgggggatgggtgagatatctccctccagcagcagcacttaggccacattaccctctgaggaatccacatttgtcttagatagttacctgtgcagggatcagtccatttattcctattttctctgacagctggatgaaagggactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaa

SEQ ID NO: 193944 - DNA, 1117 bp, Homo sapiens
  Payload ID: 18309
  Gene Name: transmembrane protein 218
  ENST ID: ENST00000528724
  CDS Start-End: 157-582
gactgggagttttcatcctcttgaataagaactcgacaacagagtgggaactttctgtcttgtgatccattgcctggtgatgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggaattgggaattaccaagaataaatgggaatgcacccagctggtacctgtctaggaagaaggactttgggatgaagaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtca

SEQ ID NO: 193945 - DNA, 1828 bp, Homo sapiens
  Payload ID: 18309
  Gene Name: transmembrane protein 218
  Uniprot ID: A2RU14
  ENST ID: ENST00000531909
  CDS Start-End: 420-767
gaagttggccgttgaaagagcaacgctgattagtgaatcttaaatcacctaaatgaaagcccacttgtgattcgccctaagtaaaccagagccccgtgggctggaacgcgccggaatctgaggtgtgagtagagcctgggggagagtggatccaggtgaagggggcagaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataatagctaaagggctgactttcacttcgaactcttggccacggctttttaatcaagttctttaggtttccttgggattagaggaaaggtatggaaatattgttttttgttttttgtcttgccatgtatctgtaggtttttttcttccatgatgtggtgggctgtgtgtgccttatttaattaccatgagtccattttggggtgtcttcacttttcatctttgtagccctttctccaaagctagtgaggaaggtatattctcaacatcagatataactctatacctgtctgatctcccagaccaaatgaaatttgcattaaatggaggggccctggtcaggttccactttggaagtctgatcctgactccctagagccatttgaaaaagaatcttctggcttaaaattaagaaccaagaaaacaagttggaaagagatcactgatggagtatgtgctctatgccaatagcacactaattcctttgaggtttaatttat

SEQ ID NO: 193946 - DNA, 999 bp, Homo sapiens
  Payload ID: 18310
  Gene Name: transmembrane protein 219
  Uniprot ID: Q86XT9
  ENST ID: ENST00000279396
  CDS Start-End: 141-863
gaggaggagggtcggggacggaagcgcagagcacggaccccgccccctcgcggccccgctcgtgacgtcgcggggggcgccggcctccgcccggccccgagggcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccagtgg

SEQ ID NO: 193947 - DNA, 1024 bp, Homo sapiens
  Payload ID: 18310
  Gene Name: transmembrane protein 219
  Uniprot ID: Q86XT9
  ENST ID: ENST00000414689
  CDS Start-End: 168-890
agggaacaagcttcaattgaatgaaactggcttgaccacagaggaatctgggggactttctgagcttcgcggacttgtgccgcctcctgactttaagctggctctggaggaggaggaagtggaggtatctcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccagt

SEQ ID NO: 193948 - DNA, 443 bp, Homo sapiens
  Payload ID: 18310
  Gene Name: transmembrane protein 219
  ENST ID: ENST00000569481
  CDS Start-End: 1-299
tgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccc

SEQ ID NO: 193949 - DNA, 1249 bp, Homo sapiens
  Payload ID: 18310
  Gene Name: transmembrane protein 219
  Uniprot ID: Q86XT9
  ENST ID: ENST00000561899
  CDS Start-End: 67-789
gggcgccggcctccgcccggccccgagggcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataa

SEQ ID NO: 193950 - DNA, 1292 bp, Homo sapiens
  Payload ID: 18310
  Gene Name: transmembrane protein 219
  Uniprot ID: Q86XT9
  ENST ID: ENST00000566848
  CDS Start-End: 468-1190
atggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctgagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaat

SEQ ID NO: 193951 - DNA, 721 bp, Homo sapiens
  Payload ID: 18310
  Gene Name: transmembrane protein 219
  ENST ID: ENST00000575829
  CDS Start-End: 81-721
gctcgtgacgtcgcggggggcgccggcctccgcccggccccgaggggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggagctggctctgtgtggctccaggctgctggtcttgggctccttcctgcttctctt

SEQ ID NO: 193952 - DNA, 926 bp, Homo sapiens
  Payload ID: 18310
  Gene Name: transmembrane protein 219
  ENST ID: ENST00000570255
  CDS Start-End: 1-695
tgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcagacagaatcatacacattcttttgtggctgacttctttcaagcaacattgtgattttaagactcataactagttcacatccaagcatttgggtaacaatggtgtgaatcaacttcttgggccttggctctgagttggaaaaggttttagaaaaagtgaagagctggaatgtgggggaaaataaaaagcttttttgccca

SEQ ID NO: 193953 - DNA, 760 bp, Homo sapiens
  Payload ID: 18310
  Gene Name: transmembrane protein 219
  ENST ID: ENST00000569445
  CDS Start-End: 1-510
gactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatcaaataaggattaaatgagaatgaccgtgaagtgcccagcacattgcctgggacatagagatttgataagtgacagctattgttgtttactattgtctttaaaacattctctctacttcaaagga

SEQ ID NO: 193954 - DNA, 588 bp, Homo sapiens
  Payload ID: 18310
  Gene Name: transmembrane protein 219
  ENST ID: ENST00000602948
  CDS Start-End: 141-588
gaggaggagggtcggggacggaagcgcagagcacggaccccgccccctcgcggccccgctcgtgacgtcgcggggggcgccggcctccgcccggccccgagggcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaa

SEQ ID NO: 193955 - DNA, 3106 bp, Homo sapiens
  Payload ID: 18311
  Gene Name: transmembrane protein 220
  Uniprot ID: Q6QAJ8
  ENST ID: ENST00000341871
  CDS Start-End: 466-948
ctttttctttctttctctttcttcctctctcccctcccgcctgccttccttccttttttccttcttttttttctttcttctttttttttttttttgtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcacgtggcaggactcaccgccccgcgccgtgttctccgagccatggcgccagcgctgtggcgggcctgcaacggactcatggccgccttcttcgcgctggcggccttggtgcaggtaaatgacccagatgcagaggtgtgggtggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtcttgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgtagaggcagggtttcaccgtgttgtccaggctggtcttgaattcctgagttcaagcgatctgtccaccttggcctcccaaagtgctgggattacaggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggactataactacattctaaatgagaaataaggtcaaaatctatatacattctttataaatggatgtccaaagtaatcctagggaggagagcttttttttttttcatttccattttcatttaaaaatggatacttgattattggaaaacttacaattgtgtttggaacaacttgggtatttgaatctaattttccaattgcaaattttatgatacctaaatacagataaagtatttccaatgaaaatttagtgtccaaatgagtggggctataaatgtaaaatacactggattttaaagacatggtagaaaaagaacagaaaatattttttgtattgattacatgttgaaacaatattttggctataatgggttaaatatactattaaagttgattttatctgtttctgtttacttttatttacgtggcttacattgcatttctgttggacagtcctgtatttaagtatctagatggcaacattttacatacacaagcatcaaactctgtggtcagatactgttttttctgatctaggaaagagatctgggaaatacttcactcaaaaagaacgagtagtgccttccacaggttaggagagtgtaaatgagtctggtagtttgtctatttttattgtctttattactatagtaaatattctataaatatttgttaaaggaggtatgtgtattttgtttttgttattggcacagtggccactgaatggtgagaaattatctaagattaagacttgaatgagtaaaaagggggaaaacaaatctagttgatattaaaacagtcaaagtgaaacttaagggtcagtaaaatacacataaaggatttgagttttccagtgtatattttgcttacatatttgtggcttttataactcctttagtattaataaactactgaagtcacatgcaaaaaaaaaacagactcatttgcaaattccctgtgggctctatccattgaccaagtcatgtttacttctgtgcttaaagacagtaatgttcaagatgtgctttcatcatgtatgcctctcccatatcagactacgaaattatgtgactattcatagtctctttcgcatcttcagttaagcatataaaaggcacttttggtggaatagtcttttgaagagtattaatgaaattgaatttaagtattattattaaatttaatatttctatta

SEQ ID NO: 193956 - DNA, 1402 bp, Homo sapiens
  Payload ID: 18311
  Gene Name: transmembrane protein 220
  Uniprot ID: Q6QAJ8
  ENST ID: ENST00000455996
  CDS Start-End: 173-625
cttcgctccccgcccccgggcggagcgacggccacggcagtgtccccaaggcaccgaaaccgaggcgggggtctcggtccctccgcgcaaggaggaaggcggaccgtacgtggcaggactcaccgccccgcacgtggcaggactcaccgccccgcgccgtgttctccgagccatggcgccagcgctgtggcgggcctgcaacggactcatggccgccttcttcgcgctggcggccttggtgcaggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtcttgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgtagaggcagggtttcaccgtgttgtccaggctggtcttgaattcctgagttcaagcgatctgtccaccttggcctccc

SEQ ID NO: 193957 - DNA, 437 bp, Homo sapiens
  Payload ID: 18311
  Gene Name: transmembrane protein 220
  ENST ID: ENST00000580787
  CDS Start-End: 1-260
gtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaaaggcagagtcttgctttgttgcccagactggaaggcagtggcccgatcacagctcactgcagcttcaaactcctaggctccagtgacccactcacctcagcctcccaaagtgatgggattacaggcgtgagccaccacatctggccccaagaactgttttcaatgatagcattttatttaatattataaaattaatatgaagaagttgctactaaaagaagcactttagcaaataaaatttaatagatcaggt

SEQ ID NO: 193958 - DNA, 559 bp, Homo sapiens
  Payload ID: 18311
  Gene Name: transmembrane protein 220
  ENST ID: ENST00000578345
  CDS Start-End: 136-528
cagtgtccccaaggcaccgaaaccgaggcgggggtctcggtccctccgcgcaaggaggaaggcggaccgtacgtggcaggactcaccgccccgcacgtggcaggactcaccgccccgcgccgtgttctccgagccatggcgccagcgctgtggcgggcctgcaacggactcatggccgccttcttcgcgctggcggccttggtgcaggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcaggaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaa

SEQ ID NO: 193959 - DNA, 376 bp, Homo sapiens
  Payload ID: 18311
  Gene Name: transmembrane protein 220
  ENST ID: ENST00000581949
  CDS Start-End: 1-353
aaagtatctctgcaatacacatactcttttgtacggtgtgggctgttggcttggcgtcctacctcttgcatcgtacacaacagaacatcttacatgaggaagaaggcaggttcaagctattcttctgcctcagcctcctgagtagctgggattacagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgttttt

SEQ ID NO: 193960 - DNA, 1930 bp, Homo sapiens
  Payload ID: 18312
  Gene Name: transmembrane protein 221
  Uniprot ID: A6NGB7
  ENST ID: ENST00000341130
  CDS Start-End: 106-981
cccctcggggaccccctgaggaccctcggattccccccaactcccctgccctctaaaaccacttcaattcctcaactcttcccccggcccgcaggaacccccgccatggcccgttcttacggcggccgggtgctggctgcaatgaccctgctgggcatcgcggcggccgtgctggcggcgctgggcgcgcagctgctgtttcagctgcaggcgggccgcgccgagctgcgggggctgcgcgccgaggggctgggccaggagctgggcgccggccccgggctgccagaggacgcggccgggacgctgctgccgctggccgccgcgctggccgcgctggtgctcgtgctggggttcacctgcttgctgctcgccgcgctctgtggccacctgggcgccgagctggcgcgggggcctggccccaggaggtctgactggtttctctacgactgccgcctcctcagacatgtggcccttggccttttctgctgtgggatctccgtctatttagcagcactgtccatctatgccttgctacttttcgagatcgagacaggcgcagcagctgcttccatcctcggctcgggcaccctggttctggtggctgtgctgacccacactctcctccgggctgcccgggctgcccgccgtgggctccatgagttgtccccgccatcctttgaagacgacctcgcccgccctgccgaagtctccaaggccagccccagagctcagcctcagcagggtatccatcgtcggaccccctattcaacctgtccagagcctggggacccctttgggtccatggccactgccacagcacctgcagccctggagggaggctgggagagcagcctgcctgcatccagaatgcaccggacactgtcggctggcctggggcactgggacggggttacgcacgagatgcgtcgaatgctgggccacagaccagggagcatggggaaggactccacactggtgtgagcccagggatgaggaatagagacctggtgtaagaaaaggataccatagagataggttcgggttcagctgcagtagcagtaggacttgatttttctctcattttattgcatccttggcttttgtcctcaaggttgcctcgtggcacaaaataattgccagagctccagccttcacctcctcattctgagggaaagtcagaggccagcgctggctaggtgtctcctggaagtcttcccaggaagcctcgaaacccttctttttatatcccactggccagaacagagcgaaatggccataccttgctgcaggggaggctgggaaatgtggctgtccagatggatgagattctgttacaggcataaggggagcggggggcttaggcagtgattctctaagtgtctccatccatttcacagatgaggaaacggaggccccaagagaggcagtgactcaccagggggcccacggccaggactgagcaccagagccaggattctcacctgaaccccataatctccatgctgctgatgtgcaagtctcagactctgcaaaatccactgcaccccctcgggctgtgaacatttcaaatccatgtgtgccaagcttggagcagcccagggccaggggcacggctggagagctggacccaggttcctggctgtggacccatggctgagggcttagctgctttgtgcctcagtttcctcatctgtaatatggggacacgaagtggccctgtctccaagggctctgacaagacacatgacttcatgtgaggcattccggggacccccacacaataggtcctcaatgtgtgttaatcgttctcatgctgctgctgcttttggggtgtaggcatgggtagtttctggggctcaaggaaataacagaggggtctccaaaggtctcctgtcttgcacaacccacaagtaaactctgatattcacta

SEQ ID NO: 193961 - DNA, 1599 bp, Homo sapiens
  Payload ID: 18313
  Gene Name: transmembrane protein 222
  Uniprot ID: Q9H0R3
  ENST ID: ENST00000374076
  CDS Start-End: 39-665
accagagccggggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 193962 - DNA, 986 bp, Homo sapiens
  Payload ID: 18313
  Gene Name: transmembrane protein 222
  ENST ID: ENST00000478104
  CDS Start-End: 13-477
gccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtcccttcctaggcagagagattgagtgagtcgcccatggtcgccacagcatggacacagcagagcccagactcgtgagccagcatagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttggg

SEQ ID NO: 193963 - DNA, 994 bp, Homo sapiens
  Payload ID: 18313
  Gene Name: transmembrane protein 222
  ENST ID: ENST00000486082
  CDS Start-End: 44-262
caggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagacaggccgggagggcagtgtggccagaaggattcttaagtaactgacccagccctttgcccccacccctggggtaccgagacatgggtagggattagaggcaagagtggagagtcagaccatccaggaaccacatctctggaccttcagaaggaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtcccttcctaggcagagagattgagtgagtcgcccatggtcgccacagcatggacacagcagagcccagactcgtgagccagcatagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctcc

SEQ ID NO: 193964 - DNA, 1071 bp, Homo sapiens
  Payload ID: 18313
  Gene Name: transmembrane protein 222
  ENST ID: ENST00000464813
  CDS Start-End: 17-460
ggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcaggtgagctgccctcctgcctgcccacccacacactgcccagaggctgctctcccaaggatcctagaaagaccattcctagcgtccttcagtcagccaggacagttggaacagatgccagttggagccgtggtggttctagagtgacgagctgagggcctgatggagagggaggtggctgtgctgaagtccagctccacctgggccccaaatgcagctctggctcttgcctgctgtgagaccatgggcaactgccttggtctctcttagccacagctgtctctggtgaaatgcaggcaatgattccggctcctcagggaggcttctacggatccctgtgctccggtaaagtgagcagatagatcctctcataatgactgccccacaggtcccttcctaggcagagagattgagtgagtcgcccatggtcgccacagcatggacacagcagagcccagactcgtgagccagcataggttagtgctgatctggccgcctctccaagctttcctcttagccacgttcatcattaagaggttctgaaaagaagacttttagggatatttttaagtactgcatggcttttagaagtcccctgagaataactggtcacacaga

SEQ ID NO: 193965 - DNA, 679 bp, Homo sapiens
  Payload ID: 18313
  Gene Name: transmembrane protein 222
  ENST ID: ENST00000498220
  CDS Start-End: 1-600
aagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtgtcacctccaggaagccttctcacaccccatcttagtccgttctggctgccataacaaaatctcatcaattgggtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcc

SEQ ID NO: 193966 - DNA, 1665 bp, Homo sapiens
  Payload ID: 18313
  Gene Name: transmembrane protein 222
  ENST ID: ENST00000464720
  CDS Start-End: 51-269
ccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagacaggccgggagggcagtgtggccagaaggattcttaagtaactgacccagccctttgcccccacccctggggtaccgagacatgggtagggattagaggcaagagtggagagtcagaccatccaggaaccacatctctggaccttcagaaggaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 193967 - DNA, 368 bp, Homo sapiens
  Payload ID: 18313
  Gene Name: transmembrane protein 222
  ENST ID: ENST00000466759
  CDS Start-End: 44-286
caggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaaactcactctcctgccctttgggaacaaatgaggcatggaaggtagaagagaggcattgtttggagctctgctggaaagttctggttggagagaataaaaaccgttcaaccttc

SEQ ID NO: 193968 - DNA, 1511 bp, Homo sapiens
  Payload ID: 18313
  Gene Name: transmembrane protein 222
  ENST ID: ENST00000608611
  CDS Start-End: 50-577
cccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 193969 - DNA, 1613 bp, Homo sapiens
  Payload ID: 18313
  Gene Name: transmembrane protein 222
  Uniprot ID: Q9H0R3
  ENST ID: ENST00000611517
  CDS Start-End: 54-680
atggggacgagcggcaccagagccggggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcc

SEQ ID NO: 193970 - DNA, 1288 bp, Homo sapiens
  Payload ID: 18314
  Gene Name: transmembrane protein 223
  Uniprot ID: A0PJW6
  ENST ID: ENST00000307366
  CDS Start-End: 28-636
aagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaaacaaaaaaaaacgccaatcttagaatggagtaacaaccagggtcacacaaggaggtcaagattcattaacaacaaataaaggagcagtcatccctagggcagctgcctaacagtacctctaagtttcagtccatgtctgcttagccttcactccttcctcctatctagttgtactttaacatcaaaaactcactactaagatgaagacagtaatataatattttggtacaaaaacagctgcaggaagaggtggaggggggcctgtcattatgtttcccccccaccccccaacgaaaggaaaactaagactcccaacataaacagggccttgaggggggggattacaggcacttgggcatggagtcttcggctgcaggaagcactccgcttattcttcaggaatgggaaaggcgtgacccaacgagagcatctgtctcagagctccactcagggtcacccctctccagaggcc

SEQ ID NO: 193971 - DNA, 857 bp, Homo sapiens
  Payload ID: 18314
  Gene Name: transmembrane protein 223
  ENST ID: ENST00000528367
  CDS Start-End: 1-412
ggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcgggtatagcacaataagaaaccgacaaaaacagcagctgatgactcactccaacaacgcacagcaccagaaggcaaggaaatcaaacctcagaggctaaatgttccatgacttctccaagatcatgaagtaagcactgagtaagtagggagggggagcaaggactcaaccccttgctcctaatctttactctataccgcattcaggagccgccagctgtatggggaacaaggcctggatcccaccccaaagacatggattggagacccaccccttggtgaccctagacccgccaatagatcgttgtgaagctgcagtttccctatctgtaaaatgggagcatttagtccaccagcgcgaaaggcacggagggagtttccctattatatgaccgtacacgaaatctagactgtgaccaaagtctcccgctcctcagcctcctctcctccgcatcctcagccactagtcacgctggagaggaggcgtgggaactgacctccgcgggccgggcctcggcaacgcgcatcctcccacccggcctagcc

SEQ ID NO: 193972 - DNA, 736 bp, Homo sapiens
  Payload ID: 18314
  Gene Name: transmembrane protein 223
  ENST ID: ENST00000525631
  CDS Start-End: 4-324
gccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcgcttgatcatctccactacactatgctttatttctcgacaaagctcagcacaaatggcttctgatttaacggatggacgcaggttctgcactgacttctgtttcggaaccacagtaaggctgtgcagcaggagccacgaaacccgactccacctagtgctttaagacgctactgacccgtccctttggcgaggggacaacttcgaagtatgacctggccaggaggagccacaaagcgcgattagcctcgctgcatttcaggtacaggccggcgccagccgtgcctcaccaggtccaccggctccgagcagcagcaagcccggtcggaaagcgaaagtggcctcgccatgtccagaccggccagctcccccgcctacctgaccccgccccgcagccgcacctgggtccgagtcatcgcc

SEQ ID NO: 193973 - DNA, 1107 bp, Homo sapiens
  Payload ID: 18315
  Gene Name: transmembrane protein 225
  Uniprot ID: Q6GV28
  ENST ID: ENST00000375026
  CDS Start-End: 218-895
gcagtcctgacagcaggctggccctgatagataacggaagtgaggaagggtgagagttatctatcttctctgttttatagactacttcagcttctgctgttaccaatgcctcagcaaccactgaaagttcagatatcacccttcttgtaactaatcaaatcaaggaagagatctacaaaatagtggtggtggttccagctagaaattttcactcacaatggtgcatgtttcaaatagaagtatccagggtatgaacatacttttctcctcctgggccgtagtcttaatggtgatgggaatcaccttagataaatgggttgaattgatttcagaagatgaaagagccaagatgaaccacagtccttggatgatgtgttgccctgctctttggccagaagatgacctgaaagtggtcaggattatgatgacgtcgagccttggcctttccttcctccttaacttaatcctgggtatgaaattcacctatctgattcctcaaaataaatatatacaactcttcactaccatcctcagtttcttctcaggtatctctctgctctgggcactcatactatatcacaataagctgaagcaaggtcaatccatgcacttctctagttataggatcacctggatcatgtatactgcttacttaaatgttttcttcttgtctgtctgtggagtcctctctctcctagagtgcaagttgtctaccagtagctgtacctgcctgaacatccataaatctgacaacgaatgtaaggaatctgagaattctatcgaagatatttcattaccagaatgcactgcaatgcctcgtagcattgtccgtgcacacactgtgaattccctaaacaaaaaagtccaaacacgtcacgtaacctgggctctgtgatttggcaatctatttcttgcagtatatgctcatctttatggaaaaagctttgtgggtgtgtgctgtgtctccaaccatgttgtctctatttggaattatggttggggtttgtaaaaagatctggaagatggttttttaaaaaatcctggcctgctgaacgaatagtttcttctgcaacatttgttgttaatataataaatattatcatataa

SEQ ID NO: 193974 - DNA, 659 bp, Homo sapiens
  Payload ID: 18315
  Gene Name: transmembrane protein 225
  ENST ID: ENST00000528595
  CDS Start-End: 209-659
acagcaggctggccctgatagataacggaagtgaggaagggtgagagttatctatcttctctgttttatagactacttcagcttctgctgttaccaatgcctcagcaaccactgaaagttcagatatcacccttcttgtaactaatcaaatcaaggaagagatctacaaaatagtggtggtggttccagctagaaattttcactcacaatggtgcatgtttcaaatagaagtatccaggatgacctgaaagtggtcaggattatgatgacgtcgagccttggcctttccttcctccttaacttaatcctgggtatgaaattcacctatctgattcctcaaaataaatatatacaactcttcactaccatcctcagtttcttctcaggtatctctctgctctgggcactcatactatatcacaataagctgaagcaaggtcaatccatgcacttctctagttataggatcacctggatcatgtatactgcttacttaaatgttttcttcttgtctgtctgtggagtcctctctctcctagagtgcaagttgtctaccagtagctgtacctgcctgaacatccataaatctgacaacgaatgtaaggaatctgagaattctatcgaagatatttcattaccagaatgcactgcaatgcctc

SEQ ID NO: 193975 - DNA, 2108 bp, Homo sapiens
  Payload ID: 18316
  Gene Name: transmembrane protein 229A
  Uniprot ID: B2RXF0
  ENST ID: ENST00000455783
  CDS Start-End: 21-1163
ttcggacagcctccgagcccatggcggggagcgacgtggacagcgagggccccgcacggaggggcggcgcggcgcggcgtccgggggcccctggcgggccaggaagcgaggcggcagccggctgcccggagccgctgtccactgctgaagcgccggctgagagcgccacgctgcccgcctggatgcgcctctacttctacgggatgcacgggatcaccctggacgtgctggtgtcctcggcccggcgcttcgcccgcagcccggacctgcggatgctaggcttctcctcgccctaccgctgcctgctgcactcgctcacccatttcgccctggagaaggtgtacctgcagcagcggcgctgtcccaacgccttcgtcttcaatttcctcctctacccctcggcccacgtggggctgcagaccctagcgggccaggcgctactactcagcctgggcggcggggcgggggtcgcggtggcgccaggggcgctggacctggcgctgcagtacgtgctggcgctctaccactgccaagtgttcctgaagcgcttcctgcgcttgcggtacgggcgacagaggcggcggcagcagcaacagcagcagcagcagcagcagcagcagcggaggggcgcgctccccgtccctcccggcgcccgggtccctactgcggccggagcccggcggcgacgaccccgtggccccaggggcgccgggggagcccccagccaggggctgcccgacctaccccgctttcttttcttcggaatgcacggctttctggatgagatcttcttcaccttcttcttcaacgtactggggcagggggacgggacaaccagcggccacacgtcgctctggtccttctttatgtacggcagctgcagtttcgtggtggaaaagctctacttccacctccactacagccgcggttggggcacttggaagcgggtgcccatctacgtgatcttcatctacgtgtgggagctgtcctggggtctgggactccgcacgtgcggggcttgttcctgggactattctcactacccgctcaattttatgggcctcatcaccctgatgtatttacctggctggatattccttagtgtgtaccaggacctaatttccaacgtgttgtggagggtgcagtacgtaccagctaactaaaaccaaaaaagaaagaaagaaaaggaaaaagtcactggattcccacgaatggatgcgatttatttttacacatttaaaatgaagtgggttttttagtcctttaatttttatacgctttactaaactcttccaaattgttttattccaccttttagtttttctatttgaaacccgtgtataatatactttgaaacactactcgaaacataattcaaagtactttatttgccaatgttttaaaacatttacaagcccaaacgtttacacgcccaaacagcaaaaccgttataccttaacatcagaatgatgtagtagtgtttacccatctggcaacagatgagtgacagctactaatttttttttttttggcggggggggatctttaaatcagagaccagtgatttttacaagatttggctaaattttctgattcagtgatttgttttactttctttttaatctaatttcattttaattccttgccatatttaccaatgactgaagaaactcaatgtcttgtactcttgagactacagttaatagctcttaaagtgcctccgtctagcacacaagtgaaaagaggctgaaaaatgtgaaagcacgttctatgaacagatttttaaatgagaggtcttttctagcaactcacacaggtgacactgtgttaagatatttgatctccatcctggaaatgattgctttccaatgtgggtaagccttaaacagcaggtgtgttaacgttgatcagatcctgtgttatctatggctgtaaatttttgttactgtgcaataatgtaaaatgtttaccttacatagccgagggccaagtgaaattatatcaccttccacagtgttctaactccaaggacccttttctacatggaacttcaagggcagaaacattacctttgaataaaatgaacctgaatgttcactctaattaca

SEQ ID NO: 193976 - DNA, 4068 bp, Homo sapiens
  Payload ID: 18317
  Gene Name: transmembrane protein 229B
  Uniprot ID: Q8NBD8
  ENST ID: ENST00000357461
  CDS Start-End: 411-914
gccaggcggcgtgggggaggcacggcccgcaactcggcgcggggggagccagagcgccgggcttgggggcggggagcaggcggtgcaggagagcgccccgagtcccggcgcgggaggaggagcgggagccagccctggagacggcgctcctagccgcacctgcgcctggcaggcggccggctctgcccagcccctacccacggccccggccccgcaccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcaggtgcttgcttgcaaccaatacctccccaggggcctgctgagctgcagccgaggagagactgggcagccaggaggctgcgtggcagcaacgctggtctgcaagggctgggagaccctcccttggctcctctcccctcccccagggccctgcgctgctcccttggccttctggggcccccgtggtgctggattcccaccaaccttgggcttttggaggtttcaatccccgtgtgttcggtggcgtttcccccttttctgtcttgttttcaaagcctttaccactagcggctctttatccacgtcggtcgccacacctgccccaccccagctccctagccagcacaggagctgccggagatgaagccctgagacacccccaaccctcacccccttgcagcccttccctccactgttccggctggcctgatgcctggggagttcctgagttacacctccctacccccggtctagtgggctgtggcagtgctcccttctcagtggctcagctgagaacaaatgatgccctccaatgcacaggcaggctgggttaggccctgtggatccacagtggggacctagaggcaagtcagtttggtggggaaaagccagagttctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagctcactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccaccccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatactttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacaacccatggcctgaccacgggatctacaggttcagatctcaccagggatagcccagacttcaattcttgcttttttgggtatcagggccccaatcccttagtggccagggactcaaagtttggaataatcccagccctgccaagcattaagggtgctggtggggagtgtttgctggctgttcatgaacctctggtgtcctgggcctctctccactagacatggcagcatctctgagttacagattgcaatgtgttgccctgcatggttgaactgcttcggacatctgctaggcatcccatgtgccctgtcccctcttcaatgccagtgagtcacaatggcctatgcttattcacagcaataatacctagggagtccccatgaagcccttttgtcctggtccctcactctgcgtgggtctcctggggaggcagctgctgagtgggtcagttcatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttccagga

SEQ ID NO: 193977 - DNA, 655 bp, Homo sapiens
  Payload ID: 18317
  Gene Name: transmembrane protein 229B
  ENST ID: ENST00000554480
  CDS Start-End: 417-655
gtttctgttttagttctgacttgtgccgtggatgtggctgagggcctagggtggggagaagtctccacaggtgggattgaactccccaggcacatggtccttgtggtgctggtggagagagagtcccagagggttcggacatgctccgttaaaaccttttcctcaaggtgataggtacgtgtcaaggtgacccctgtccgccatccggcaggctggaagaagccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatcta

SEQ ID NO: 193978 - DNA, 3941 bp, Homo sapiens
  Payload ID: 18317
  Gene Name: transmembrane protein 229B
  Uniprot ID: Q8NBD8
  ENST ID: ENST00000557006
  CDS Start-End: 284-787
gcagtttgcagcgcatccgtactatggggcagtgggcagccatgccgagtcatgaaggtggcatgcagggatgggaaatgctgccttaggagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcaggtgcttgcttgcaaccaatacctccccaggggcctgctgagctgcagccgaggagagactgggcagccaggaggctgcgtggcagcaacgctggtctgcaagggctgggagaccctcccttggctcctctcccctcccccagggccctgcgctgctcccttggccttctggggcccccgtggtgctggattcccaccaaccttgggcttttggaggtttcaatccccgtgtgttcggtggcgtttcccccttttctgtcttgttttcaaagcctttaccactagcggctctttatccacgtcggtcgccacacctgccccaccccagctccctagccagcacaggagctgccggagatgaagccctgagacacccccaaccctcacccccttgcagcccttccctccactgttccggctggcctgatgcctggggagttcctgagttacacctccctacccccggtctagtgggctgtggcagtgctcccttctcagtggctcagctgagaacaaatgatgccctccaatgcacaggcaggctgggttaggccctgtggatccacagtggggacctagaggcaagtcagtttggtggggaaaagccagagttctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagctcactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccaccccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatactttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacaacccatggcctgaccacgggatctacaggttcagatctcaccagggatagcccagacttcaattcttgcttttttgggtatcagggccccaatcccttagtggccagggactcaaagtttggaataatcccagccctgccaagcattaagggtgctggtggggagtgtttgctggctgttcatgaacctctggtgtcctgggcctctctccactagacatggcagcatctctgagttacagattgcaatgtgttgccctgcatggttgaactgcttcggacatctgctaggcatcccatgtgccctgtcccctcttcaatgccagtgagtcacaatggcctatgcttattcacagcaataatacctagggagtccccatgaagcccttttgtcctggtccctcactctgcgtgggtctcctggggaggcagctgctgagtgggtcagttcatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttccagga

SEQ ID NO: 193979 - DNA, 701 bp, Homo sapiens
  Payload ID: 18317
  Gene Name: transmembrane protein 229B
  ENST ID: ENST00000557779
  CDS Start-End: 536-701
gccgccgccgccgccgccgccgggggctcctttcctcccgggcagcggcggctgcagccccccggaccccgcgccgccgcggcggacgccgacacacaatgcgggactaggcgcggcgcgggagtgccaggcggcgtgggggaggcacggcccgcaactcggcgcggggggagccagagcgccgggcttgggggcggggagcaggcggtgcaggagagcgccccgagtcccggcgcgggaggaggagcgggagccagccctggagacggcgctcctagccgcacctgcgcctggcaggcggccggctctgcccagcccctacccacggccccggccccgcaccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacct

SEQ ID NO: 193980 - DNA, 523 bp, Homo sapiens
  Payload ID: 18317
  Gene Name: transmembrane protein 229B
  ENST ID: ENST00000555994
  CDS Start-End: 354-523
cgggagccagccctggagacggcgctcctagccgcacctgcgcctggcaggcggccggctctgcccagcccctacccacggccccggccccgcaccgggcagtgggcagccatgccgagtcatgaaggtggcatgcagggatgggaaatgctgccttaggagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccat

SEQ ID NO: 193981 - DNA, 2812 bp, Homo sapiens
  Payload ID: 18317
  Gene Name: transmembrane protein 229B
  Uniprot ID: Q8NBD8
  ENST ID: ENST00000555638
  CDS Start-End: 233-736
agacgcgagcatgtgcagtttgcagcgcatccgtactatggggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcagatggccaccattatttctgttttatgggagaggtctgttggcaaagagtcggccacccagatttaccacatttctctgcagaacactcttttgttcaatataagcagagaccttccaccgggggcaggatttgtgatacctgcagtgagccaaggaccaggctagttcctgtgatgctgaagatgttgaagggaagcccataacattacaacgttgaccaatcctccagaaaagaagctctaacagaggaccctggctgtctacggggttggtttccatctctccattcgtgagctccttgaaggcagagaacacttggcttttcttcctatacctccagtccctaatgcagggacatgagagatgcccatttgtgtttgatgaatgaatgagtgaataaatgaatgaatgagtgcctggagatcagagtacatgggatgagtgttcggagttctacagactcaggaagccccagctgacattccaagaagaaggagacacgaaggtgaggggatgccatgcagttagcgtcacatgaagaaaaacaaaatttaaggtatcatccttagaagacggagggatgacagtttcaaggaggatttgttcatcagatgctgggaaggaatttcaacagatgaggaaactgaagagcagagaggttaagtacccccctaccctgccccccaggggacacaacctgctggagtgcaatggcacgatctcagctcactgcaacctctgcctcccgggttcaagcaattctcctgcctcagcctcccaagtagctgagattacagatgcaaggtagagagtggaaggaatgaaggggtgggcgagggcatgaagaagcctccccagctctaatggccactgtctgaaagtgatgcagctcacttccacccacattcgccagatttcaatccatagcctcacttaactgtagggcaggctaggacatatcatctttccatgtgctgagaaaaaatagaaaagaccaagattggtgaaaaggagcaaactagtgacgagaaccttgccatagccatttttttgccactcacagaagccggtctgtaccaagcgagaagtggctataggagaagtggtcctgaggctcatctgccttctcctggtcaccctcccaatatatccctcctgtgctgagctagttttctattacttttcatcacctacatctaaaagagacctacctatctaacacagtctttgtcttactatcataatgctattaatgcaagctaaataataatctttcatcttctttttttctttatctttttcacttgaattgctttaaattcaaatcttcctgctatagtgtgaatgtttgtgttccccccaaatttatgtttaaactttaacctccaagctgatggtattaggaagtggggcttggggaggtgattaggtcatgagggtggaatatttgagaatgagattagtgcccttgtgaattaggcctgagagagatcccctcatctcaccatgtaaggacacagcagaaggtgctatctttgaaccaggaagtgagcccttgccagacactgaacctgccgatacctcaatcttgtccttctcagtctccagaactgtgagaaataaatttctgttgtttataaacc

SEQ ID NO: 193982 - DNA, 699 bp, Homo sapiens
  Payload ID: 18317
  Gene Name: transmembrane protein 229B
  ENST ID: ENST00000554278
  CDS Start-End: 296-699
aaggggtgaaagggagcgagcaccgatagcaaggtggcagcctgcacgtccgctccgagggcccttcccaggagcggctggatctgaccgatccccaagtccagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcat

SEQ ID NO: 193983 - DNA, 1472 bp, Homo sapiens
  Payload ID: 18318
  Gene Name: transmembrane protein 230
  Uniprot ID: Q96A57
  ENST ID: ENST00000202834
  CDS Start-End: 159-521
ctgtttccggcacgccacttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193984 - DNA, 1562 bp, Homo sapiens
  Payload ID: 18318
  Gene Name: transmembrane protein 230
  Uniprot ID: Q96A57
  ENST ID: ENST00000342308
  CDS Start-End: 60-611
acttccggcgcactgatcccgcctggggccggctgagtggcacttaagcgggccatgccatgcaaccttgggcgctgccaaccgtgggcgagctctgggtgtgcgggcggcctggcgcggcgctccgatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193985 - DNA, 306 bp, Homo sapiens
  Payload ID: 18318
  Gene Name: transmembrane protein 230
  ENST ID: ENST00000379276
  CDS Start-End: 85-306
tctgaagacgggtaggagaataacgtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaaggg

SEQ ID NO: 193986 - DNA, 1536 bp, Homo sapiens
  Payload ID: 18318
  Gene Name: transmembrane protein 230
  Uniprot ID: Q96A57
  ENST ID: ENST00000379277
  CDS Start-End: 223-585
gtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193987 - DNA, 1636 bp, Homo sapiens
  Payload ID: 18318
  Gene Name: transmembrane protein 230
  Uniprot ID: Q96A57
  ENST ID: ENST00000379279
  CDS Start-End: 323-685
ggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacggctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193988 - DNA, 1660 bp, Homo sapiens
  Payload ID: 18318
  Gene Name: transmembrane protein 230
  Uniprot ID: Q96A57
  ENST ID: ENST00000379283
  CDS Start-End: 347-709
tggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtagagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193989 - DNA, 1735 bp, Homo sapiens
  Payload ID: 18318
  Gene Name: transmembrane protein 230
  Uniprot ID: Q96A57
  ENST ID: ENST00000379286
  CDS Start-End: 422-784
aagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacggatggagtctagttctgtcgcccaggctggagcccagtggtgtgatctcagctcactgcaatctccacctcctggcttcaagcgattcttctgcttcagcctcccgactgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193990 - DNA, 1642 bp, Homo sapiens
  Payload ID: 18318
  Gene Name: transmembrane protein 230
  Uniprot ID: Q96A57
  ENST ID: ENST00000379299
  CDS Start-End: 329-691
aagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaa

SEQ ID NO: 193991 - DNA, 594 bp, Homo sapiens
  Payload ID: 18318
  Gene Name: transmembrane protein 230
  ENST ID: ENST00000615008
  CDS Start-End: 182-565
aaattcgcgtcggttcttatttctctccctggcaaggtctgaagacggggtctcattctgtcgcccaggctggagtgcagtggtgcagtctcggctcactgtaacctccgtctcccaggctcaagctattctcgtgcctcagccttccaaatagctgggattacagctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggagtctcgaatccacctcacgggaacaaaagaaagctgaccacaaacatctaccagcatcccgtgggtacatgatgggaggcatcagtgggaggagtcccgaaggaggactcagctcaaggcttccagaaggaagaggaacacaggtgtcatcacctgactgaggttctgaccaatggaacacaggtggaag

SEQ ID NO: 193992 - DNA, 1231 bp, Homo sapiens
  Payload ID: 18318
  Gene Name: transmembrane protein 230
  ENST ID: ENST00000612323
  CDS Start-End: 143-526
acttccggcgcactgatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggagtctcgaatccacctcacgggaacaaaagaaagctgaccacaaacatctaccagcatcccgtgggtacatgatgggaggcatcagtgggaggagtcccgaaggaggactcagctcaaggcttccagaaggaagaggaacacaggtgtcatcacctgactgaggttggtgcctctaatttgagataagcatcttaaaagggctaaactgaaaatgtcctaggaataagtacgtcagcatgaaaatgactgattgtaaaatgcagcagagagcttctcctactaagagcaggatatgtggagggaatgttccatatgcctagaggagcaggccaaaggaattccagctgccctctaccccctatgcaactcctcttgtgaatggtgagaatggcgcagaccactccccatggccccacctctgttcctgagggtaggaggattcctgtccccttcataccatccttggtactgagagcgatgctgaagagactgggatgctcatattctcacaaagggactgcagggtggtacagatggctggatgcccagtactacatccattctcccctttttctttagtaatagaaccactgaaccttagctggatgagtaataaaaccgctggataatcttggcctaacatggtgatatgatttggctctgtgtccccacccgaatctcactttgaattgtaatccctgtaattcccatgtatcaaaggaggtactaggtggaggtaattggatcatggggtggtttcccccaagctgttcttgtgatagtgagtgactctcatgagatctgatggttttataagcatctggcatttcccctgcttgcactcactctgtcctggtgcgctgtga

SEQ ID NO: 193993 - DNA, 4278 bp, Homo sapiens
  Payload ID: 18319
  Gene Name: transmembrane protein 231
  Uniprot ID: Q9H6L2
  ENST ID: ENST00000258173
  CDS Start-End: 78-1028
gtggagaccgaggcgatggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaataaaaaagtcaaaatggaagatcacatgtacctttttcgagggaaagggtttggaatggcaaagaatagggagggcagaggttgcacacacctgtctttattactcatctacagccatgctttacaaggctctgcctaacgaccttggaacttccatgaggtctttggtgaaagtcccctagttcttccccaggtagatgagttttcagtgggattcacatgccatgtgaaatctacgtgttggataattatgactgtgtctggtgaatatgaaattatttacagaccagatgttgatagtttctgactctgaatcacagcatagctgcaagaggtaaataaaaagcaagaggccgggagcggtggctcacgcctgtaatcccagcactttgggaggccgaggtgggtgaatcacaaggtcaggagatcgagaccatcctggccaacatggtgaaaccccatctccactaaaaatacaaaaattggctgggtgtggcgacacgtgcctgtcatcccaactatttagtaggctgaggcaggagaatcgcttgaaccctggaggcggaggttgcagtgagccgagattgcgccactgcactccagcctggcaacagagctagactccgtctcaaaaaaaaaaaaaaaaagaaatatagaggattttattaactcagctccgacccatagctaagttaaggtttgatgttattactgaatatttggaggcagaaagactcctgattttgccaaatgattagtacagtttcggcttaagtcagatgaggcccccctaatattccatcatgtaaggctaataaagcaattatttcttttttttttttccttccaacttttattgtagactcatggggtatatgtatgggtttcgtatatagctaaattgtacaacctgggggtttggtgtacagattatttcatcacccacgtaataagcatagtacccagtaggtggtttttcttttctttttctttttcttttttttttttttttttgagacagagtctcactctgttacccaggctggagtgcagcagcatgatctcagctcattgcagcctctacctcccaggttcaagtgattctcctgccttaccctcccgagtagctgggattacgggtgcccaccaccatgcccggctaatttttgtgtttttagtagagacagggcttcaccctggtggtcaggctggtctcgaactcctgacctcaagtgatccatccgctttggccacccaaagtgctgggatcacagcagtttgatcacagaagttattatggttggcattctggcacacatctttctaatcttttttgttgtatgtaacctttttagtatcacaaacaacacttttataaaccttgtgtagaaa

SEQ ID NO: 193994 - DNA, 2991 bp, Homo sapiens
  Payload ID: 18319
  Gene Name: transmembrane protein 231
  ENST ID: ENST00000562410
  CDS Start-End: 60-380
gcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtggaggagataatgcctgttgtgtacagcaagacagtgggtcattgtgtatttacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaa

SEQ ID NO: 193995 - DNA, 922 bp, Homo sapiens
  Payload ID: 18319
  Gene Name: transmembrane protein 231
  ENST ID: ENST00000570006
  CDS Start-End: 25-606
gcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcgaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaag

SEQ ID NO: 193996 - DNA, 1078 bp, Homo sapiens
  Payload ID: 18319
  Gene Name: transmembrane protein 231
  ENST ID: ENST00000565067
  CDS Start-End: 32-838
ccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagcttt

SEQ ID NO: 193997 - DNA, 2920 bp, Homo sapiens
  Payload ID: 18319
  Gene Name: transmembrane protein 231
  Uniprot ID: Q9H6L2
  ENST ID: ENST00000568377
  CDS Start-End: 40-1077
ggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacggtgagcctgccccggccgctgtgccacgaggctccccgggcgcgctcggccagggccggcctccctaaccgcctccctaccgccctctttaactcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaat

SEQ ID NO: 193998 - DNA, 1003 bp, Homo sapiens
  Payload ID: 18319
  Gene Name: transmembrane protein 231
  ENST ID: ENST00000615437
  CDS Start-End: 1-164
tccaacaccaggtgctgctcgtggccctgctcggacccgaaagcgacgggttcctcgcctggagcacgttccccgccttcaaccggctgcaaggggatcgcctgcgcgtcccgctcgtttcggtgcgtggttcccgcctgggcctggggcagagtcggggatagggtggggatggggactggaatgaggatgtggggcgagcggccccggccctggggagcccagctttgatcctaaggactcgcgaacccgcaaaggtggcgtttcatctcctaggacctagggaatcgatcttctgtttcattctgcttctcccagatgtccccggcccccagaaagttagccatgctgtcagcgtgtgcgccctgacacagagtccagaagtgtgggggcagcctgtgtctgcccgggtcacacccgcgggcctggcctgatggagggtgtttgtgaaagtccatttaggagcctggaaggccgcgcgctgttaatgtagataaccccattctgtcgcggcgtttctgcatcacaccactataggaacggaaagggcagcatttttatgcagacctgacccctggaaaccaaggcgctgattggttaagcggccttcccagaacgcgctgtggccgagtcacgcctccctgggtttgtcccattggagactgcgccatcctgaagctgtcgggatgaaatggaagcatgttactgtctgtaatttatttatttatttttaaattttttcaccagtagagcgctgagaggaatctgtaatttagtatttgctttgagataagcgaatgcttcctttgtagtcactccttttcactcattttctgaaaacgttttcctttagaagtatgaaacttctggttttccttctttcaaattcgaatctcttcagacatatctaagatgattgccctacaagccaaccttgtatagctgaggagaaaagaaaatcagacttgttcccagcaactaaataaaattgtttttaaaaatc

SEQ ID NO: 193999 - DNA, 2501 bp, Homo sapiens
  Payload ID: 18320
  Gene Name: transmembrane protein 232
  Uniprot ID: C9JQI7
  ENST ID: ENST00000455884
  CDS Start-End: 52-2025
agcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagatatgagaacacagattctgatatgggaggatatgaaattaaccacctgctctggcactgtgttgctgcttggtcttgtgttcagaataacagtcctcagttgaataacgtgcttgaacatctcgtcttccataagacacagcttcaaaagaaatgctggttggattcagtactggctttactggtccttggggaggctgccaaattaaacatggcctgcttgaaagctttaatggacgtagtgagagattttgtttcaagcattatgtctgttcaaaatcaggaagaaagttgcaaggtagatgatttttcctgggcctggaatgtagtctacatatatacagtaattcttgcagaaatctgcttgtatgcagccacttctgatttgcgaaaaactgctttaattggtttctgtcactgtaaaagttcacaaaaaaatattttatacttggacaaatcagtacctccagaattaaaggaaacaagtattttaagtcttttggaatatttctcttcaaaaatgtcagagaactgtgatcaagtagtctggactggttactatggcttagtgtataacctggtgaaaatttcatgggaacttcaaggagacgaagaacaggatggacttagaaacatgatatggcaaacattgcagaaaacaaaggattatgaggaagatgtacgaatccaaaatgcaatcaatatagctcaggctgagttaaatgacccaactgatcctttcactagatatagtacaaatatttcatcaaatgtaggagaagaagttttctccaaatatattgggtggagaattgccaacactctttccaaactattctttccccccattgaggcccattttcttcctttgaagaaaccatcaataaaaaaggatcaaacaaaatatccaaataaaaagctggagtctgtgaaaaagcaagttctacatttcactgtaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaacagtatggcatcttatttgatt

SEQ ID NO: 194000 - DNA, 1024 bp, Homo sapiens
  Payload ID: 18320
  Gene Name: transmembrane protein 232
  ENST ID: ENST00000515278
  CDS Start-End: 533-1024
atagcctcttccggcaaccattaaagggcacggttgctagggagacgcggcggtaacctggaccttaaaagtttgttgtcgttagggaataggtgggaatatggttgtgggattaatgaaacacagtaccaaagagattccagaaagagaactggtgtaggaatagggcctgcatgggaggagttcaaagatgcttcttggagggagccgataacccgcgggtggagcctacccgagacagggcatcactgtgttgccaaggctggtcttgaactggctcaagcaatctgcccacctcggtctcccaaagtgctgggattacaggagtgagccactgcgccctgcctgaaattgaacacaaatgtggtggagacgggacagggcaggtggaaattcacttataagtcctgattggctaagccctggtcacgagaccgtaaaagagcaacgtctgtctcagagcgactcccacagcgtccttagcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaag

SEQ ID NO: 194001 - DNA, 822 bp, Homo sapiens
  Payload ID: 18320
  Gene Name: transmembrane protein 232
  ENST ID: ENST00000511883
  CDS Start-End: 80-822
agccttggttcccagcggctcagagcgcagcggaactctatgaggaaataccattctcattttacagaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaag

SEQ ID NO: 194002 - DNA, 582 bp, Homo sapiens
  Payload ID: 18320
  Gene Name: transmembrane protein 232
  ENST ID: ENST00000512886
  CDS Start-End: 225-582
agatgcgaaccttgattgagagtgataatcaactttgttttgattgaactgacatttttttctgtggttttatcactttttattttttatgggtgtataagacagggcatcactgtgttgccaaggctggtcttgaactggctcaagcaatctgcccacctcggtctcccaaagtgctgggattacaggagtgagccactgcgccctgcctgaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatggtacgtactttaaat

SEQ ID NO: 194003 - DNA, 1974 bp, Homo sapiens
  Payload ID: 18320
  Gene Name: transmembrane protein 232
  ENST ID: ENST00000512003
  CDS Start-End: 58-237
gtccttagcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagatatgagaacacagattctgatatgggaggatatgaaattaaccacctgctctggcactgtgttgctgcttggtcttgtgttcagaataacagtcctcagttgaataacgtgcttgaacatctcgtcttccataagacacagcttcaaaagaaatgctggagcctattgaggcaaatcctgtgctttacctagagagaaacttcactttgagaagctctgcacaaatactatggctgctggtctacattttttcaaggttggattcagtactggctttactggtccttggggaggctgccaaattaaacatggcctgcttgaaagctttaatggacgtagtgagagattttgtttcaagcattatgtctgttcaaaatcaggaagaaagttgcaaggtagatgatttttcctgggcctggaatgtagtctacatatatacagtaattcttgcagaaatctgcttgtatgcagccacttctgatttgcgaaaaactgctttaattggtttctgtcactgtaaaagttcacaaaaaaatattttatacttggacaaatcagtacctccagaattaaaggaaacaagtattttaagtcttttggaatatttctcttcaaaaatgtcagagaactgtgatcaagtagtctggactggttactatggcttagtgtataacctggtgaaaatttcatgggaacttcaaggagacgaagaacaggatggacttagaaacatgatatggcaaacattgcagaaaacaaaggattatgaggaagatgtacgaatccaaaatgcaatcaatatagctcagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaacagtatggcatctta

SEQ ID NO: 194004 - DNA, 3081 bp, Homo sapiens
  Payload ID: 18321
  Gene Name: transmembrane protein 233
  Uniprot ID: B4DJY2
  ENST ID: ENST00000426426
  CDS Start-End: 391-720
aatttggaacttaatgggcctttgcgtcctccttccctgagcctccttttattccagacttctcagtgtgagtctgtgcgtccctccgacgatctcagggagtggggtgccttcatctgcctgttccctgttcctcaggctgacgctcccgctgtcctccccgcctcccctcactccttttctccctcccttcctccttgtggggaggctcttggccagggtccctgagcccgggcgggtgctggcagaggacgcagaaggggtgaggtcacgtctcccttgagccccgagccgctggcttttcagagcctcgccacaagccggcggccagagccccagaccacacagaccgtgcgctcctccgccctcccggcgccgccggcctcgcccatgtctcagtacgcccctagcccggacttcaagagggctttggacagcagtcccgaggccaacactgaagatgacaagaccgaggaggacgtgcccatgcccaagaactacctgtggctcaccatcgtctcgtgtttttgccctgcgtaccccatcaacatcgtggctttggtcttttccatcatgtctctgaacagctacaacgatggagactacgaaggagccaggcggcttgggcggaatgctaagtgggtagccatcgcctccatcatcattggccttctcatcatcggcatttcttgtgcagttcacttcacaaggaatgcctgaggaaccagcggtcagtgggctgtgagcgtggaggatggacctcatccacacacaccccaaaggagtttctaaggaatggatccttgacttcagactgtgagatcttttcctccaggactctccagaggcaggtccctggcaaatgaacaagaaaaaaaaaaaaaaaaagtccaaaatttaggcaatccaagctgcacagccggatcagccaaagtcattgatttgtaaaaatgaaaagaaaacagaaaaaagaaaaatgaagtctcactgtctcagtttagcgaatcccgttgtgtccactcctgtcctccagaggcgagcctcaggaaatcacataacttttcactgaggggatccagggggtctccatatagggggagatggaggtttctaggaagagcagcaggtgctggtatttacaatgttgagcacaaacatttgcagcatgtttaaaattgtctagtagagttcaagttgtggatttgcttttccttttattcttataaccttcagtaactcctcctctgggagtcagcactcccatgcccagagttcacccatctggtcatcaaacactcaaagaaggggcttttctggccttttgtcttgatgcttatatttccaaataggccccctcccttgcttgcatccacgttggtcaacttgaccaaaacctcactcttcactcaaacaggctctgagaatggacttagtggccaattctaggtacatgagcacttcctgtatcccagttttgggaataaactggctgtatttatagaatgtgctttttttttttcaatttctcactctctctcctatctctagcaagtctcaggcaagatctttgattttcctggatgccacctggaaatgccacccattgtgtttcttttctgtcaaatgtaaaccctttagatgtgaatgtactggtttaatgatgccattattctgcctgccagaacgcagtaacccagtgtctcacagagcacaaggggtgtgccactggtggtacacaagataatttttaagtagtttctaggaacaacattaagtaataccaaatcacaaagaatgtttccccttttctattcttttttcatcctgattacagcaaggaaaaagtctctgtttagtgctagcaggtcctttacacctttcagacactatggctcttttccctttttagcaaagaaagagcaggcctcagagtcttctgtctagatagaatttaatgatattgttttgtgtcatggtatttattttatttattaccttccatttacagcttcccacagtgggggatgtgacatattgtttctgttcaaataaattaagaaaaacaagagaactcaagaaaatatcaagtaattaacacaccagataagtatatgtggcaaaagtcacttcaaagaattaatgtcagaaagatggtgataatgaagcaaaagaaaggcagattatgctggccgggcgtggtggctcacgcctgtaatcccagcaatttgagaggctgagatcacttaaggtcaggagtttgagaccagcctgaccaacatggtgaaactccatctctactaaaaatacaaaaattagccaggcgtggtggtgcatgcctgtaatcccagctaatagagaggctgaggcaggagaatcacttgaatccagaaggcggaggttgccgtgagctgagactgtgccactacactccagcccggggtgacagagcaagactccatctcaaaaaaaaaagaaaagaaaacgaaagaaaaagaaaaaagaaaggcagattattctaattgaatgaataagaggctgagagtcaatacctagttccaacgcccttttgtttttgcagggtttttattggccactaactagctatgcaagctgattttaggcaagtttcatagcctctctgtgcctaaaattccttcacctgcaaaatggggataagaatgcctgcctacttacctcacagtgctgttatgagaattaattgttgtaatagttgtgactaaccattggcggggagaattctaagtactataccaatacaaatttcagcattttttcatatactgaaccctagcaaaaaaaaaaaaaattctgatgaacatcagattcaacctgtcattttacccggatgttgtgatgagccagcacttgtcccaggaggacgttgaatcagggacacgaaatctcagcacacagagattctagcatcattccaatagattggaccctgatttctgtttctgacatcctgttttttgtttgtgcgtgtttgggtccctggtcttttacccaaatcaaatgaaaagtgttgctcagaggcagaataaaaatggttttaagtaa

SEQ ID NO: 194005 - DNA, 1082 bp, Homo sapiens
  Payload ID: 18322
  Gene Name: transmembrane protein 234
  Uniprot ID: Q8WY98
  ENST ID: ENST00000309777
  CDS Start-End: 4-426
gccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaa

SEQ ID NO: 194006 - DNA, 721 bp, Homo sapiens
  Payload ID: 18322
  Gene Name: transmembrane protein 234
  Uniprot ID: Q8WY98
  ENST ID: ENST00000344461
  CDS Start-End: 17-511
agacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacaga

SEQ ID NO: 194007 - DNA, 1411 bp, Homo sapiens
  Payload ID: 18322
  Gene Name: transmembrane protein 234
  Uniprot ID: Q8WY98
  ENST ID: ENST00000373593
  CDS Start-End: 22-564
gtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgtaagttagactactgcgagtgcgggacgcagctctgtggatctcgacatacctgtgttagttccttcccagaacccatctccccagagtgggtgaggacacggccttttcccatcctgccctttcctctgcagctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaa

SEQ ID NO: 194008 - DNA, 737 bp, Homo sapiens
  Payload ID: 18322
  Gene Name: transmembrane protein 234
  ENST ID: ENST00000484490
  CDS Start-End: 38-241
cccttcgttcccggaagtagaagacagcggcgttgccatggcggcgtctctggatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaa

SEQ ID NO: 194009 - DNA, 1866 bp, Homo sapiens
  Payload ID: 18322
  Gene Name: transmembrane protein 234
  Uniprot ID: Q8WY98
  ENST ID: ENST00000461402
  CDS Start-End: 26-520
ggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtaggaagttaggagatcatttactttcaatcacaagggaggagaactgttcctggggcccaaggctgccagtttccagctcagagctcctcccaccccaacatactgtttcctgatccaacagcttacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttgg

SEQ ID NO: 194010 - DNA, 969 bp, Homo sapiens
  Payload ID: 18322
  Gene Name: transmembrane protein 234
  Uniprot ID: Q8WY98
  ENST ID: ENST00000483001
  CDS Start-End: 14-508
cagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccagg

SEQ ID NO: 194011 - DNA, 1538 bp, Homo sapiens
  Payload ID: 18322
  Gene Name: transmembrane protein 234
  Uniprot ID: Q8WY98
  ENST ID: ENST00000491434
  CDS Start-End: 12-302
gcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacaggctggtcccagacctcagagttcaggtcttcatgctggaatcctgggaagcactgaacgtggagtcaggagatgtgggtttgagtcctgagatttgctgtgacttcatctggaagatggggttttgataccttttttaaagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttgga

SEQ ID NO: 194012 - DNA, 1412 bp, Homo sapiens
  Payload ID: 18322
  Gene Name: transmembrane protein 234
  Uniprot ID: Q8WY98
  ENST ID: ENST00000489170
  CDS Start-End: 27-521
cggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttgga

SEQ ID NO: 194013 - DNA, 2409 bp, Homo sapiens
  Payload ID: 18323
  Gene Name: transmembrane protein 235
  Uniprot ID: A6NFC5
  ENST ID: ENST00000374946
  CDS Start-End: 625-1215
gtcctagaaggttctttctgcctgttttctccccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccctgcacagcccggccaggcaggtgcatcttgtttggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagtgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtc

SEQ ID NO: 194014 - DNA, 2490 bp, Homo sapiens
  Payload ID: 18323
  Gene Name: transmembrane protein 235
  Uniprot ID: A6NFC5
  ENST ID: ENST00000421688
  CDS Start-End: 625-1296
gtcctagaaggttctttctgcctgttttctccccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccctgcacagcccggccaggcaggtgcatcttgtttggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagggcagaacggctgcatcccgctggtcgacccttttgccagtgagagcctggacgtctccacctcggtgcagcacctcatcttgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtc

SEQ ID NO: 194015 - DNA, 1187 bp, Homo sapiens
  Payload ID: 18323
  Gene Name: transmembrane protein 235
  Uniprot ID: A6NFC5
  ENST ID: ENST00000551068
  CDS Start-End: 122-793
agaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagggcagaacggctgcatcccgctggtcgacccttttgccagtgagagcctggacgtctccacctcggtgcagcacctcatcttgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcaga

SEQ ID NO: 194016 - DNA, 1786 bp, Homo sapiens
  Payload ID: 18323
  Gene Name: transmembrane protein 235
  Uniprot ID: A6NFC5
  ENST ID: ENST00000550981
  CDS Start-End: 1-591
atggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagtgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtca

SEQ ID NO: 194017 - DNA, 1481 bp, Homo sapiens
  Payload ID: 18323
  Gene Name: transmembrane protein 235
  ENST ID: ENST00000591033
  CDS Start-End: 1-766
gctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagggcagaacggctgcatcccgctggtcgacccttttgccagtgagagcctggacgtctccacctcggtgcagcacctcatctgcagctcccagcttggctggatcctgcgggccttgcagactcctggctccccatttaggactcgattcttccagatggcctgctgtctacctggctggcaccttccacctgtgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcc

SEQ ID NO: 194018 - DNA, 2272 bp, Homo sapiens
  Payload ID: 18323
  Gene Name: transmembrane protein 235
  Uniprot ID: A6NFC5
  ENST ID: ENST00000586400
  CDS Start-End: 625-1077
gtcctagaaggttctttctgcctgttttctccccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccctgcacagcccggccaggcaggtgcatcttgtttggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaaggtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtca

SEQ ID NO: 194019 - DNA, 5464 bp, Homo sapiens
  Payload ID: 18324
  Gene Name: transmembrane protein 236
  Uniprot ID: Q5W0B7
  ENST ID: ENST00000377495
  CDS Start-End: 45-1100
caaagagggagtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagtttttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccctggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatacttttttttttttttttgagacgatgtctcgctcttgtcccctaggctggagtgcgatggcgcgttctcagctcactgcaacctgtatctcccgggttcaagcgattctcctgcctcagcctcccaagtagctgggaatacaggcacctgccaccacgctggctaatttttgtatttttagtagagacgaggtttcaccatgttggccaggctggtctcaaactcctgacctcaggtgatctgcccacctcggccttccaaagtgctgggattacaggtgtgagccaccacgcccggctggattatactttttaaaaatttgaaaattgtagttttaggggttccttcaaaggtggaattatattctttattccattgtggcaagggacttttattcaataaattgatttcagcataaaaagcaattcactttaacagatatttggctcagtttaaggcttagctgtattgccagtactgaagtactaatatgagtgttgtttagtataatgaagtcaaggtacatcagtaataccaagataaagtttcataataaaaagccataaagtgaagacagagatttcaaagtaaaagaatattttatttgtggaatttgatactttgataaataatcaaagtacaagccctgtttaaaattaaaagttcggcttacaaatataatagccaatgtatcagtgtcttatgtgatactatatcatggatatattgatgttataaaataattagatacagagtcatgcaacttgctttcaccctgttgggacactctgaacagtcagcactgttcatttgatagtaattttcagatgctagagagatttgtgagaggctgataatgcaagagtaatgatttatgtagccagtttcttcaatgatctgtgataacaaatcattaagaatgagacatatggcttaagaatgaagcttaagaatttgacatatggccggctgtggtggctcacacgtgtaatcccagcactttgggaggttgaggcaggtagatcactggagtccaggagtctgagaccagcctgggcaacatggagagattctacctctacaaaaaatacaaaaattagctgggcatggtgatctgcaactatagtcccagctacttaggaggctggggcaggaagattgcttgagcccaggaggtcaaggctacagtgagctatgatcatgccactgcactccagactgggcaacagagtgacacccatctaaaaaaaataaaagagaatttgacgttgtgttattctacgctccaccaaatacctctccccttgccaccctgtctccctttccctctgttttaggatttttctcacactgtaaaagaagatttactcacagttgttaaaagcttgccttccagctttctaatttgaggtaggttctataacctctgtgggtccccgtttccacatgtaaaagatgaacataatactagtactacattaatagggttaggagggttaaagggtaaagagtcctttgagcacattttctggcaaaccataataacttgataaatgctaagcattggaacgggtaccaagtctccaagaaacaagtatctcaatgcagttttagaaatttcctgttttattcttttctgtggccctgctcaccctctgggaataatcatttcaactttgcatttgtgaaaaataatacatacaatcttaaggttacttcagactatactttttcatcgaggagtattgtattcaaaagtgatcgatctgctgaatatataaattaaaatggacacaagccttcattcatcagacatttgagtgtctgtcctctgagttcccatagaatctgaattacaccactttattcacacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggctgaggcaggagaatcacttgaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactctgtctcaaaaaaaaaaaaaagtcaagtacagttagttaaaggaatgtgcatttaaaaattaatctatgattaggctattaatatatagtctaataattttattgcattataattataaagtagttttataattttataaaattttattgatgctgtaatttttataaaattttatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaatacataattgccttgtgctgtgtaccttggagcagggccttacatagtgaatatatcaatagttgttcacaaaaagagcaatataccacttagaagctacaaaacttaaaaatggctacttatactccatagaagatatagtaaataatagaagaaaaaaatgaaatggctaaagacattttgttttacaatggggctgtttttacatgttaattaaaattctatgtttaaacaaa

SEQ ID NO: 194020 - DNA, 1805 bp, Homo sapiens
  Payload ID: 18325
  Gene Name: transmembrane protein 237
  ENST ID: ENST00000286196
  CDS Start-End: 159-515
caggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataattt

SEQ ID NO: 194021 - DNA, 5415 bp, Homo sapiens
  Payload ID: 18325
  Gene Name: transmembrane protein 237
  Uniprot ID: Q96Q45
  ENST ID: ENST00000409883
  CDS Start-End: 118-1344
cctcgccaggcgccacgaagccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 194022 - DNA, 5592 bp, Homo sapiens
  Payload ID: 18325
  Gene Name: transmembrane protein 237
  Uniprot ID: Q96Q45
  ENST ID: ENST00000409444
  CDS Start-End: 319-1521
ttcccgcaaacaaatcaccgccaccacttaggaaaccacgggaaagctgtgattgcagcgccacggtcgccagatttctgctcctgggcacattacccccaactccgaggccccctttttggcagggctagtctggactggccaatccaggtccctgcacgcctctcaccgcaacatccccgcagggcgctgcgcgcggggtactagccaggcggcgcggcccgatgacgcattgcgcctgcgcgcgcgaccgagccgggaggggtggggcgccaggtgcttgggggccggcggccgccgaggccggctaaacgcagaatggggaagaatcctgtgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatgagaccctaaagctcaagttgaggagaagactagctatgggaaaaaatgtttcaaaggctgttgagcacatcaataaaactattgagcctgccctgattagcaagcacctgaatgttatagaacagaagaggattgacaaattgatgatagagacagttgaccctgacaataggtctaaatttggagtgaacattatactgggaatctcttttgctgtttgtaaggctggagctgccgaaaagggattctccctgctgtcacagaattgtgaatttgctggcaattctgaaggcatcctgctagttccagctttcactgtgaccagcaatggttctcaatctggcaataagctggcagtataggagttcataatcttccccgtcagcaaacttcagggaagccatgctcgttagagccaaggcttagcacacttgagccgtgtcatcaaagagaaatgtgagaaagctgctgccaatgtgggggattgtggtaggctgcataatgtctcctaaagatgtccatgtcctaatccctggaacttgtgaatatactactttacttggccaaagggatttgcagatatgattaaggttatgaaccttaaaacggggacattatcctgtattatccagaagggtccagtgtaatcttatgagtccttaaaagcagagaagaaagccttttatgtctgtggtcagagaggtcagaagttatgatattgctggctttgaagatggaagagggggccatgagccaaggagagtgatgaccttgcagctgagtacggcccttggccaacaatgagcaaggaaatggatttcagtcacataaccacaaggaactgagttctatgagtatcccaaatgagcaaggaaacaaatcctcccctagagccaagaaaggaaggcagctctgtggataccttggttttggcctggtgctgcccatgtcatacttttgacatacagaactgtaagatagcaagtgtatgttgactaagctgctaaattggtggtgattgcttatggcagcaatagaaagctatatatcctagagaataaagaaggctagagctgctgtggaatgcacttgggaaagctggctacattgataatatgtaactgccatgggcatagttgcctttgtattcttccaggtctgggaagtacaacttagacttcagatctcgtaatgacccaggaggcatataaacctgagcagctagtggccctgtacaagtccttcatcagggaaaaacattgagtattccctgattaaggacttgtacagaggactctgttttccctggtgtttctggtgtgtctcaaaaattgtttgactgtgatgacagggaagtttggaagaagttcactgctaatgcatgtctccaggaagcagggaatgatctcacagtgacacttgaggcacattgctgaggccgtcgatgagaattcatgtaactttctccagcttacagtggactagattgacatgcaagctgatccagtccaattggtagggcatcatggtttctcattactcactgacttaaaatacttttattgccatcctggtgaagcactgcactgggtagataacacaggggcaccttgctgatcagagcccttggccaggtacaaagagctcagtttctaaaactctgtcatttcaataatgttataaattgaatcatacagtatgtaattttatgggattcgctttttttctgttgatctctttttttctgagtcatctcagctgttgtgtgtatcaatagttcatttccttttactgttttgtttggtttaactcattgacctattgaaggatatctgggctcattccagtctgtgaataatgctgctgtggacattcatgtgcaagtttttgtgtgaacattaagttttcatttctttaagataaatgcccaggagtgaaactgatgggttgtatgtagttacaaactgccaagctgttttccagagttggcggtaccattctaatttcccatgacaattttttgaagagtccaagctagttgctttagagtgcctcacctacattttttaattgtctgactttttcctaatgacatcacttaatttgttcctcaatctcctgaatttcctatagactggaggttaggtctggtggtttgattagattttttaaaaaaatatgacttcatctgtgatgctgtgtactttatgttgcataacatgaaccctaagaacagagtgagctgctggacagcaagtttcatggggtgcagtaattaacacaccacatagtataaatctgaaataatgacaaatgtgttaagggccttgggatattgggccatgtactctgaggagcacaaggtgaggtgcaggttcctgcccctaaagaactctatcttttgagattagcaactaacagtgtgagcccactaataggatgtgaaagttgtcaaaatcaagttctggtcattgtgttaaaaatcctaacaaatagagctggggaaggccgtgaaaggacgattttcatgcacagatgtctgataatgaggactatcattaaaagactgcacaaaaccacaccttgcacaaaggccatcacaacctgacacacacaaaaaatacttctatgaggacatttgcccagcaactccctgtccaatgtccaactggcaacatccttgttattgatccttgtagccaaggataattctctcaaaacaatcatttttgctttaaaaaccgttgtcttccttgacctccctgtatatgcacatagtttactgtggcacttgtattcttattgcaatgcctactcctgaataaacatcattttctttcagagagtctccctctctgttatttaggctgacaaggatatgccaagaagtagcttggatatagcagttaactctgcctttaggatatgtgtatggggatataagagttaactaaaagctgacctttgagttggtccttgaataaaagaagaatagattccaaaaataagaggaataaataatgatcctgagctaggagagtacattttgcagacctttggtttccatattaagaaattcagatttttatgtacaataaagaagttctggaattctctg

SEQ ID NO: 194023 - DNA, 779 bp, Homo sapiens
  Payload ID: 18325
  Gene Name: transmembrane protein 237
  ENST ID: ENST00000444047
  CDS Start-End: 3-293
ccatgaggactgactcgggggctcggctggaggagggccacctgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaaaacggcgtgtcttgattggatggaagaattataggagtagaagggcaggaactagaaaagtcaggagaatggagcataattttggaaggatgaccaatgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttca

SEQ ID NO: 194024 - DNA, 1071 bp, Homo sapiens
  Payload ID: 18325
  Gene Name: transmembrane protein 237
  ENST ID: ENST00000432684
  CDS Start-End: 171-461
agcagcgcctggcaggacagaggcgggcggggacctggctcagggggcggctgcctcgccaggcgccacgaagccccggcgtcccacaggtcccggaggccgctgcgtcgcggggagctgggctcgggccgccggcggttgcgccggggcagccccgcggggagagcaccatgaggactgactcgggggctcggctggaggagggccacctgcgtcctccacgagctcttccacctgtgccaagtcaagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaaaacggcgtgtcttgattggatggaagaattataggagtagaagggcaggaactagaaaagtcaggagaatggagcataattttggaagaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatc

SEQ ID NO: 194025 - DNA, 1824 bp, Homo sapiens
  Payload ID: 18325
  Gene Name: transmembrane protein 237
  ENST ID: ENST00000621467
  CDS Start-End: 67-1269
gagccgggaggggtggggcgccaggtgcttgggggccggcggccgccgaggccggctaaacgcagaatggggaagaatcctgtgcgtcctccacgagctcttccacctgtgccaagtatagatgatattccacttagtcgtcctaagaaaaagaagcccagaacaaaaaacacaccagcaagtgcttctttggaaggccttgctcagactgctggtcgaaggccctctgagggcaatgagccatcaactaaagaactcaaagagcacccagaggctcctgttcaaagaagacagaaaaagacaaggctacctcttgaattggagacttcctccacccaaaagaagtcatctagttcatctttattacgaaatgaaaatggtattgatgcggagccagctgaggaggcagttattcaaaaacctcggaggaagacaaagaaaacccagccagcagaattacagtatgccaatgagctaggagtagaagatgaagacataatcactgatgagcaaactactgtggaacagcagtctgtattcactgcacccactggcattagccagcctgtaggcaaagtatttgtggaaaaaagccggagattccaggctgctgatcgttcagagttgataaagaccacagaaaacatagatgtgtcaatggacgtgaagccttcctggaccaccagagatgtggcacttacagtgcaccgggctttcaggatgattggtctcttttctcatggattcttggctggctgtgctgtgtggaatattgttgtgatatatgttctagcaggagatcagctatccaacctctcaaaccttctgcaacaatacaagaccctagcgtatccattccagagtcttctgtacttgcttttggctctgagtacaatttcagcttttgacaggattgactttgctaaaatatcagtagcaatccgaaattttttggccctggatcctacagctttagcatctttcttgtactttactgctcttatactatctctgagtcagcaaatgacaagtgacagaatccacctttacacaccttcttctgttaatggtagcctctgggaagcaggaattgaggaacagattctccagccatggattgtggtgaatctcgtggtggctcttctggttggattatcttggctatttttgtcttataggccaggcatggatcttagtgaagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttg

SEQ ID NO: 194026 - DNA, 1000 bp, Homo sapiens
  Payload ID: 18326
  Gene Name: transmembrane protein 238
  Uniprot ID: C9JI98
  ENST ID: ENST00000444469
  CDS Start-End: 340-870
cggacactgagcagaaacaacgccacgcccggctccgagtgtcccatgctgccaccactaaaatgccctgatttttggccatatgtgacctccctgggtggcacgggccctaggcacccgtggctgtgcgcctggctaccaccagctcaggcctctgagcaatagcccctgcacggaaaccacgaccagggtaaccccggccgcgccggttcgcgcccagcccggttcaggtgaccaggcgggagcttggcacacctggcgccgtcccctgaccccgccccggaccgggccgcaccccggaacgctctctctgggcgccagcggcggcggtgcagggccatggcggcggcgccagcggtgtgcgcctcgcaggggagcccgccgggtgcaccgtccgcgccggcggccgcgccagcacccgcggccggcctgggccgctgccggatggcgctgctgctggccgtggcgctggatgtggcgggcatggcggcgctgctgaccggcgtgttcgcgcagctgcaggtgcgcggccgcgacttcggggacctgctcatctactcgggcgcgctgctggtgttcctgagcctgctgggctggatcctctggtacaccggcaacatcgagatctcgcgccaggagctggagcgcgactacggcctgcggccctcggcgctcgcccgcctggcgcgcaagctctcccgccgctggtcggcgcccgccgccgcgggccagcgccccgcgcccggctcccggagagcgcgccgagccgcccgcgcgcccccgccgcccgccgccggctcccgccgcgtgcgcctgcagctcgccacgctcgaggccgggcccggggcggcgggcgcgggcagcgagtgaggcccagacaaccccttggctccagctgtcaggaccagactgagatgtgcagctgcccctacatccgtggccagacggacgctccctgtaccccctccctcctcacttggataaaaagcagatttgcctt

SEQ ID NO: 194027 - DNA, 3892 bp, Homo sapiens
  Payload ID: 18327
  Gene Name: transmembrane protein 239
  Uniprot ID: Q8WW34
  ENST ID: ENST00000361033
  CDS Start-End: 34-621
acaaaggggctcctctggggagggtgggggtagatgagagtggggacttggatctgcctgccaggccgtcctgggcgctgcaggaagcaacatgacttaggtaactgcccagaggtcccaggcatcttcaagaccctggccctctccccaggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggactccttcctcaagtcaatgctgcaggttcctggtgtgaggggctgggggctttgagaagagggggcaagacagatggcttagccattggtgaaaattgcttagccaggggcagagcttgaccaagccactgatagcgcccatatggatgtgatgatacccgtggggcccccttggcaactgacagcatctttttctcatagccactcagctgtctcagcttcagactcactgagaacttctacctgggtaccactggccttgccattcctcccaccaatcccctctttccacttccaggagaaccacagactctagagagggtcccagtgacaaaaatctatcagggagaaggctggccagaagccccaggagacctcaactcactcgctctccaaaccttgcagcccacgcatcctcctccctagacttcctacttcctgcctcagtctgcatccccaagtctgagaaatgggccaactggggtcagacagcacctactcactctctaagaatcccaaggtctgttatggaaaaatgatcaagaaatcccatttcacccacttacacaatgtgtggccttggccaattaattcatttgagcctcaatgttacgtgggccacttctgtcatggggttgttgtgagtcaaagacaatatctatttgtgaagcattttgtagaagccaaaaacctgtaagatgttgttttgagctctaagaactttctgtaggcgcataagatcttttgaccccaaagactgttgaaggaacaggaagcttctctgggctttcagatcaactctctgtcctggatagaattttggccctaaaatggtaaacaagaggtcggttaagtgtgtacaagatgtaaaaggtcatgtgccatgaaatctcaaaatgtgcagatgttgaactattttgattatgaaatgcttgggcctggggctgggtgccagatgcttgcacagctgtgtgagtggggacagcacagccccagggtttccaaaactgacccagcaagccgctcaggcaccagaagggctttggaaagggcaatcctttgatgccctgaatgctggccgttcgttcacttgctggcccctccaacaaaacattgagtgatcggtaattaccaagtaaggtacatgatagacaactttatccacacctgacccccacccaagccctggccatccccaactcctgcccagttctgatccctgctttatgtataaccctaaaatccttgctcttgaagccccagacccaaggtccccctcttttgtcccataaatactcagggccttggggctagcccctagaaccctggttcatttttgccttagacttttgcaaccctccatgccacggattagatgccttcagcatcagtgccaaaacccaaggtccagtccttcctttctgtttctttgtatttctcccgcattatggcatggtagtgagagcgaggtaggacatggggctgatgtggtctcatggttggatgggttttggtgcatgagctgaggctgggcgtgagtcccagcactctcacttactaactccatgcccttagtggaaatcgctaaaccttcctcaacttcactttcctcatgggtaaaactaaggcaagaacccctgtcttagggctctggcatgtgagtgaaggacctgggaccactcctagcaccacaaattatagctatgctgtgaccatcccattttagagatgagaagtcaggcccaggatagccagttgccagtggcaaggccaggccatctgagtcctaccaggctactcaagggaaggtgaagggggcaaaggaaacacaaacaacctaactaactgaagaccccaaggcttctcaagagctcctatcagagctaaagcccaggcctagggaagtcatgagtcaagccaatctagatggcaagctgaggattcaggatcccatgtggtgagggcagagaccaggctgcctggcctagatccatcattgacttggccatgcattgctagccagggacgttgctctggagccttgggtccattccaatgaagggagagaggagtttggggccctgaccagatgctctagtggatgggatgtgggcagcagcaaggagaagaccttcttcctttccccacagactatataccttttaccctcctgcccagctggtatggggtaaggaggtgcacccagactagagagctgatgggcaatactcatcaaattagatccacatataccctaggacccagaaccccagaatgaattttcacagaggtccataagggccttgcccctcaaaatgtagtcccagaatcagcaacacaggcatcacctggaagctggttggaaatacagtctcaggccctgctccagacaggccgaatcagagtctgcatttttttttttttttttttgagacagagtcttgctctgttgtccaggctggagtgcagtggtgcaatctcggctcactgcgctccacctcccaggtccaagcaattctcctgcctcagcctcctgagtagctgggattacaggcgcctgccaccgagtccgacaaacttttgtatttttagtagagacagggtttcaccatgttggccaggctggtcttgaatccctgacctcaggtgatctgcccaccatagcctcccaaagtgctgggattacaggcgtgagccaccgtgcctggccaagagcctgcattttaacaagattcccaggtgatacattgtaccctgtttgagaagtgaagcataagggggtattatgagaatgcctattgcactgttactagtgggagcaggataggtaaagggaagggtaaaacaaggcagatgggcccaaggggcagtaattagaaggggcagaaggtacatgaaccaatcttaaaatcttagcattgaaaaagaaatggaatgagaatacaattcctcttacacaaatttaaaagcatgtcagcaaaacaagacaatttttggcaagaacacataaaaacgaaagataaacagaatggaatggacaactctaggggcaggcaagtgggagtagggtatagagataacaggcaataaagctagagagcttgcagaggcgaaacgtg

SEQ ID NO: 194028 - DNA, 571 bp, Homo sapiens
  Payload ID: 18327
  Gene Name: transmembrane protein 239
  Uniprot ID: Q8WW34
  ENST ID: ENST00000380585
  CDS Start-End: 95-553
agatgagagtggggacttggatctgcctgccaggccgtcctgggcgctgcaggaagcaacatgacttaggtaactgcccagaggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatccca

SEQ ID NO: 194029 - DNA, 718 bp, Homo sapiens
  Payload ID: 18328
  Gene Name: transmembrane protein 240
  Uniprot ID: Q5SV17
  ENST ID: ENST00000378733
  CDS Start-End: 12-533
ggccccgcccgatgtccatgagcgcgaacaccatgatcttcatgattctgggggcgtcggtcgtgatggccatcgcgtgcttgatggacatgaacgcgctgctggaccgattccacaactacatcctcccgcacctgcggggcgaggaccgcgtctgccactgcaactgtggccggcaccatatccactacgtgatcccgtacgacggggaccagtcggtggtggacgcctccgagaactactttgtgacggacagtgtgaccaagcaggagatcgacctcatgctggggctgctgctgggcttttgcatcagctggttcctggtgtggatggacggcgtcctgcactgcgccgtgcgcgcctggagagccggacggcgctacgatggctcgtggacctggctgcccaagctgtgcagcctgcgggagctgggccggcggccgcacaggcccttcgaggaggccgccgggaacatggtacacgtgaagcagaaactctaccacaatggccaccccagcccgcggcacctgtgagccgcacggggacttaccggggccaccgagccaaccggctgctgtacagatgtaaaagggacctcgtggacgcccgggccggcgggactggacagcagccctgggcccaggttgtccggggctgtggccggccgggagagtccagtggaaggtgctgtctcttctttttataaagggggttgggg

SEQ ID NO: 194030 - DNA, 717 bp, Homo sapiens
  Payload ID: 18328
  Gene Name: transmembrane protein 240
  Uniprot ID: Q5SV17
  ENST ID: ENST00000425828
  CDS Start-End: 44-565
agggaagcgctgacctctgcggaggcggcgggggccccgcccgatgtccatgagcgcgaacaccatgatcttcatgattctgggggcgtcggtcgtgatggccatcgcgtgcttgatggacatgaacgcgctgctggaccgattccacaactacatcctcccgcacctgcggggcgaggaccgcgtctgccactgcaactgtggccggcaccatatccactacgtgatcccgtacgacggggaccagtcggtggtggacgcctccgagaactactttgtgacggacagtgtgaccaagcaggagatcgacctcatgctggggctgctgctgggcttttgcatcagctggttcctggtgtggatggacggcgtcctgcactgcgccgtgcgcgcctggagagccggacggcgctacgatggctcgtggacctggctgcccaagctgtgcagcctgcgggagctgggccggcggccgcacaggcccttcgaggaggccgccgggaacatggtacacgtgaagcagaaactctaccacaatggccaccccagcccgcggcacctgtgagccgcacggggacttaccggggccaccgagccaaccggctgctgtacagatgtaaaagggacctcgtggacgcccgggccggcgggactggacagcagccctgggcccaggttgtccggggctgtggccggccgggagagtccagtggaagg

SEQ ID NO: 194031 - DNA, 796 bp, Homo sapiens
  Payload ID: 18328
  Gene Name: transmembrane protein 240
  ENST ID: ENST00000624426
  CDS Start-End: 5-172
cccgatgtccatgagcgcgaacaccatgatcttcatgattctgggggcgtcggtcgtgatggccatcgcgtgcttgatggacatgaacgcgctgctggaccgattccacaactacatcctcccgcacctgcggggcgaggaccgcgtctgccactgcaactgtggccggtgagtccacaaccggcgccggctcgacacgcgtgagcgcacatgtgtggcggggcccactcggggcgcgggggaaccagccccacgcaggccgcgagccgccttccacccttgagggctgccaggtgcgcagggggaggagctgtctcaaggtgggcgggggtctcctgggggcgcatggctttaggacgccgttcctagaggcctccagggtgatggcggaatgggtcacggggcctcctggtccagcctggaggccggaaagccgcagcccagtgtgatgtccacagtggagacccaagccagcctcatcagggctggggcaggaagcgcctgctggcacagggctgggccctgcactgagtccctgggcaggggaatgcaggtcaaggcgggaagggcctgccttgaggggcactgggcaccacccccgggctggagaggagctgagggatgggctgggggggcagcggggaggtggagcttcctcaaggtcattcagattgaggggagcgcccagaccccccgcacccaccgtgtgaccccctctgtgcacgtgtagcgatgggatcctcttggccatgcatgtttgtacgtccatgtacgaaataaacatcttctcatgaga

SEQ ID NO: 194032 - DNA, 2934 bp, Homo sapiens
  Payload ID: 18329
  Gene Name: transmembrane protein 241
  Uniprot ID: Q24JQ0
  ENST ID: ENST00000383233
  CDS Start-End: 54-944
ccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgccatcaccctcacccaagtgaatgtggtggtggctgatgaggccgaggccctggtgcttcaaggagcaccctttctgggggtctgcaggtcactgcagaggagcggtctgttacatcttcccatttggagaacctctctcaaccgtgctgtagctggttctgcagaaacaggaagtacaggatttcatgggctggctctgctcgcctcgactgagcttcacacctctggatgccacatgctctctcccaaacactgctttcagtgcaaggtagtgggcctaaggggtttggttgtcttttttttttttcatttttaaaattttaaatttttatttattattattttttagagacaaggcctcactctatcgcctaggctgaagcacagtggtgcgatcacagctcgctacagccttgacctcctaggatcaagccatcctcctgcctcagcatccacagtagctgatgtgcaccaccagacccgtctcattttttctatttttattattttagagatggggatctcactgtgttggccaggctggtctcaaactcctgggctcaagcaatcctcccaccttggcctcaaagtattgagattacaggcatgagccactgcacccggcctttctcatttttatttttaaattgacagacgtaacagtgcgcatttatcacgcacaacacaatgctttgggaatggttaaatctagctcacaaatgcattacctcacacggttgtcatttttgtggtgaggcttggttgtatgttttgtttcattcatgtttttacatccttggagtctcctctgggtccgtcctttctttgctgtcatgctggcttgcctaaggcccaccgccacctgcgtacgagcattttaaactctagagtgagtgacagcctttttatggttggtgttactatttatttcctgcctctaaacttctcgtggtccttataaacttgtcaggatgtgtgttgcgttgaattctgcatgtcctttttttgcccaccctcaggttaagctggtactaacttatccccagaggaaacagggtttatgagcactgacagatgtcttccctgggcaaaaaaaaaaaaaatagtatatgtatacacacacacatacacatttatatttatatttcttaaagcttttaatccctttcattccctgatatctcagagatttcaaatcattgaacactgaagtatatttttcaggccagatgaaaaattgtattaaaaccctattcctggtcaggcgcagtggctcacgcctataatcccagcactttgggaggccgaagtaagcagatcacctgaggtcgggagttcaagacaaacctggccaacatggtgaaaccctgtctctactaaaactacaaaaaaattagcctgatgtggtgttgtgtgcctgtagtcccagctacttaggaggctgaggtaggagaattgcttgaacctgggaggcggaggttgcagtgagccaaaattacgccactgcactccagcctgggcaacagagcgagacagtctcaaaaacaacaacaacaacaaaaaccctattccttgcctttgtaggagtcaaaataaatgaacttcttttttcttttttttattattatactttaagttctggggtacacgtgcagaatgtgcaggtttgttacataggtatgcacgtgccatggtggtttgctgcacccatcaacctgtcacctacattaggtatttcccctaatgttatccctcccctagccctccatcccctgacaggccctggtgtgtgatgttcccctccctatgtccatgtgttctcattgctccaaaataaatgaatttacac

SEQ ID NO: 194033 - DNA, 2941 bp, Homo sapiens
  Payload ID: 18329
  Gene Name: transmembrane protein 241
  Uniprot ID: Q24JQ0
  ENST ID: ENST00000473688
  CDS Start-End: 110-589
gtctctgggcggctgctgccgctgccgctgctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgccatcaccctcacccaagtgaatgtggtggtggctgatgaggccgaggccctggtgcttcaaggagcaccctttctgggggtctgcaggtcactgcagaggagcggtctgttacatcttcccatttggagaacctctctcaaccgtgctgtagctggttctgcagaaacaggaagtacaggatttcatgggctggctctgctcgcctcgactgagcttcacacctctggatgccacatgctctctcccaaacactgctttcagtgcaaggtagtgggcctaaggggtttggttgtcttttttttttttcatttttaaaattttaaatttttatttattattattttttagagacaaggcctcactctatcgcctaggctgaagcacagtggtgcgatcacagctcgctacagccttgacctcctaggatcaagccatcctcctgcctcagcatccacagtagctgatgtgcaccaccagacccgtctcattttttctatttttattattttagagatggggatctcactgtgttggccaggctggtctcaaactcctgggctcaagcaatcctcccaccttggcctcaaagtattgagattacaggcatgagccactgcacccggcctttctcatttttatttttaaattgacagacgtaacagtgcgcatttatcacgcacaacacaatgctttgggaatggttaaatctagctcacaaatgcattacctcacacggttgtcatttttgtggtgaggcttggttgtatgttttgtttcattcatgtttttacatccttggagtctcctctgggtccgtcctttctttgctgtcatgctggcttgcctaaggcccaccgccacctgcgtacgagcattttaaactctagagtgagtgacagcctttttatggttggtgttactatttatttcctgcctctaaacttctcgtggtccttataaacttgtcaggatgtgtgttgcgttgaattctgcatgtcctttttttgcccaccctcaggttaagctggtactaacttatccccagaggaaacagggtttatgagcactgacagatgtcttccctgggcaaaaaaaaaaaaaatagtatatgtatacacacacacatacacatttatatttatatttcttaaagcttttaatccctttcattccctgatatctcagagatttcaaatcattgaacactgaagtatatttttcaggccagatgaaaaattgtattaaaaccctattcctggtcaggcgcagtggctcacgcctataatcccagcactttgggaggccgaagtaagcagatcacctgaggtcgggagttcaagacaaacctggccaacatggtgaaaccctgtctctactaaaactacaaaaaaattagcctgatgtggtgttgtgtgcctgtagtcccagctacttaggaggctgaggtaggagaattgcttgaacctgggaggcggaggttgcagtgagccaaaattacgccactgcactccagcctgggcaacagagcgagacagtctcaaaaacaacaacaacaacaaaaaccctattccttgcctttgtaggagtcaaaataaatgaacttcttttttcttttttttattattatactttaagttctggggtacacgtgcagaatgtgcaggtttgttacataggtatgcacgtgccatggtggtttgctgcacccatcaacctgtcacctacattaggtatttcccctaatgttatccctcccctagccctccatcccctgacaggccctggtgtgtgatgttcccctccctatgtccatgtgttctcattgctccaaaataaatgaatttacac

SEQ ID NO: 194034 - DNA, 669 bp, Homo sapiens
  Payload ID: 18329
  Gene Name: transmembrane protein 241
  ENST ID: ENST00000497608
  CDS Start-End: 81-311
gctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaaggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccag

SEQ ID NO: 194035 - DNA, 889 bp, Homo sapiens
  Payload ID: 18329
  Gene Name: transmembrane protein 241
  ENST ID: ENST00000460322
  CDS Start-End: 95-247
ctgccgctgccgctgctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgc

SEQ ID NO: 194036 - DNA, 667 bp, Homo sapiens
  Payload ID: 18329
  Gene Name: transmembrane protein 241
  ENST ID: ENST00000482411
  CDS Start-End: 88-348
tgccgctgctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaaggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggat

SEQ ID NO: 194037 - DNA, 2859 bp, Homo sapiens
  Payload ID: 18329
  Gene Name: transmembrane protein 241
  Uniprot ID: Q24JQ0
  ENST ID: ENST00000477053
  CDS Start-End: 108-479
ctctgggcggctgctgccgctgccgctgctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaaggatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtaggttgcaccttgaaagaacaagacaaaaccaaacttcaagactatcctcctgtttaaaaggagactagcaggtgtcaaagagaggcggtaaagctcatgatacctgatgtaatcagtgccctcctcctcctggccgcagcaggatgccttcccttcaatgactcccaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgccatcaccctcacccaagtgaatgtggtggtggctgatgaggccgaggccctggtgcttcaaggagcaccctttctgggggtctgcaggtcactgcagaggagcggtctgttacatcttcccatttggagaacctctctcaaccgtgctgtagctggttctgcagaaacaggaagtacaggatttcatgggctggctctgctcgcctcgactgagcttcacacctctggatgccacatgctctctcccaaacactgctttcagtgcaaggtagtgggcctaaggggtttggttgtcttttttttttttcatttttaaaattttaaatttttatttattattattttttagagacaaggcctcactctatcgcctaggctgaagcacagtggtgcgatcacagctcgctacagccttgacctcctaggatcaagccatcctcctgcctcagcatccacagtagctgatgtgcaccaccagacccgtctcattttttctatttttattattttagagatggggatctcactgtgttggccaggctggtctcaaactcctgggctcaagcaatcctcccaccttggcctcaaagtattgagattacaggcatgagccactgcacccggcctttctcatttttatttttaaattgacagacgtaacagtgcgcatttatcacgcacaacacaatgctttgggaatggttaaatctagctcacaaatgcattacctcacacggttgtcatttttgtggtgaggcttggttgtatgttttgtttcattcatgtttttacatccttggagtctcctctgggtccgtcctttctttgctgtcatgctggcttgcctaaggcccaccgccacctgcgtacgagcattttaaactctagagtgagtgacagcctttttatggttggtgttactatttatttcctgcctctaaacttctcgtggtccttataaacttgtcaggatgtgtgttgcgttgaattctgcatgtcctttttttgcccaccctcaggttaagctggtactaacttatccccagaggaaacagggtttatgagcactgacagatgtcttccctgggcaaaaaaaaaaaaaatagtatatgtatacacacacacatacacatttatatttatatttcttaaagcttttaatccctttcattccctgatatctcagagatttcaaatcattgaacactgaagtatatttttcaggccagatgaaaaattgtattaaaaccctattcctggtcaggcgcagtggctcacgcctataatcccagcactttgggaggccgaagtaagcagatcacctgaggtcgggagttcaagacaaacctggccaacatggtgaaaccctgtctctactaaaactacaaaaaaattagcctgatgtggtgttgtgtgcctgtagtcccagctacttaggaggctgaggtaggagaattgcttgaacctgggaggcggaggttgcagtgagccaaaattacgccactgcactccagcctgggcaacagagcgagacagtctcaaaaacaacaacaacaacaaaaaccctattccttgcctttgtaggagtcaaaataaatgaacttcttttttcttttttttattattatactttaagttctggggtacacgtgcagaatgtgcaggtttgttacataggtatgcacgtgccatggtggtttgctgcacccatcaacctgtcacctacattaggtatttcccctaatgttatccctcccctagccctccatcccctgacaggccctggtgtgtgatgttcccctccctatgtccatgtgttctcattgctccaaaataaatgaatttacac

SEQ ID NO: 194038 - DNA, 1022 bp, Homo sapiens
  Payload ID: 18329
  Gene Name: transmembrane protein 241
  ENST ID: ENST00000542162
  CDS Start-End: 18-467
aggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtaggttgcaccttgaaagaacaagacaaaaccaaacttcaagactatcctcctgtttaaaaggagactagcaggtgtcaaagagaggcggtaaagctcatgatacctgatgtaatcagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcagagcggaagagctcctg

SEQ ID NO: 194039 - DNA, 1404 bp, Homo sapiens
  Payload ID: 18329
  Gene Name: transmembrane protein 241
  ENST ID: ENST00000581444
  CDS Start-End: 81-311
gctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaaggccattcctgtgtttctcactttgcataatgtagctgaagttatcatctgtgggtaccagaagtgttttcagaaagagaaaacatctcctgcaaagatctgtaggttgcaccttgaaagaacaagacaaaaccaaacttcaagactatcctcctgtttaaaaggagactagcaggtgtcaaagagaggcggtaaagctcatgatacctgatgtaatcagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgacagaggaccagagggatggcacggagagtaggctccacacacagagagacattttctctttcaccagtgtacccaaggcaggatggcagtgcccagcacacagtaggtgctcaccaggctgcagagacggggtttcaccacgctgcccaggctggtcttgaacttctgagctcaagcgatccacttgcctcagcctcccaaagttatcggattacaggcatgagccaccatgcctggtccaaaacaatgcatgttaaaaacttagagcctggcacccagcaaacaatcaaggcatctattaccatcttatcatccttgtaactttatcatctcttctggaaatatgctccaacccagaagaatctacttcttagtctaaactttctgcgaccgtgttcctaaaatccagtgttcttttccagctatgaagtccacaacatgacctccctccaggtcctga

SEQ ID NO: 194040 - DNA, 571 bp, Homo sapiens
  Payload ID: 18329
  Gene Name: transmembrane protein 241
  ENST ID: ENST00000580025
  CDS Start-End: 81-311
gctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaaggccattcctgtgtttctcactttgcataatgtagctgaagttatcatctgtgggtaccagaagtgttttcagaaagagaaaacatctcctgcaaagatctgtaggttgcaccttgaaagaacaagacaaaaccaaacttcaagactatcctcctgtttaaaaggagactagcaggtgtcaaagagaggcggtaaagctcatgatacctgatgtaatcagtgccctcctcctcctggccgcagcaggatgccttcccttcaatgactcccagtttaatccagatggatatttttg

SEQ ID NO: 194041 - DNA, 625 bp, Homo sapiens
  Payload ID: 18329
  Gene Name: transmembrane protein 241
  ENST ID: ENST00000582336
  CDS Start-End: 62-625
ggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgtggtgctcctggcatttgcatctcatcccaca

SEQ ID NO: 194042 - DNA, 590 bp, Homo sapiens
  Payload ID: 18329
  Gene Name: transmembrane protein 241
  ENST ID: ENST00000577531
  CDS Start-End: 1-309
gatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtagtgacattgaccagcaatacttaaactatatattcagtgtggtgctcctggcatttgcatctcatcccacaggtgatctcttcagcgtcctggacttcccattcct

SEQ ID NO: 194043 - DNA, 692 bp, Homo sapiens
  Payload ID: 18329
  Gene Name: transmembrane protein 241
  ENST ID: ENST00000578520
  CDS Start-End: 104-692
gggcggctgctgccgctgccgctgctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtaggtgatctcttcagcgtcctggacttcccattcctgtacttctacagattccatggtagctgctgtgccagtggatttttgggattctttctcatgttcagtacag

SEQ ID NO: 194044 - DNA, 1030 bp, Homo sapiens
  Payload ID: 18330
  Gene Name: transmembrane protein 242
  ENST ID: ENST00000367144
  CDS Start-End: 103-489
agattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtgtaagtaactactgtcttgtccctggtatctacatgtttattctgcttactgtgttctaaatttttctggttttcaaatttatttgcatgtagtttggtcactgtctagggagatgatgacagagtacgtgactaaattcttacaaataactagacaacttcttattactaataaatacaatttttgaaggtggtaaaacttcaaatataattaagtaatgactaatttatagctaatgttctatataaattgacattagggcgagtgcagtgggttatgcctgtaatcccagcaccttgggagcctgcggcaggcaaatcacttgagctctgaagtccaaaaccagcctgggcaatgtaaagaaaccctgtctctataaaaaaattagctgggtgtggtggcatgcgcctatagtcctagctactcagaaggctgagggaggaggatcacctgagcctcacaggctgaggctgcagtgtgccaagatcattgcgcttcagccttggcagcggggtaagaccctgtctcaaaaacaaagtagaataaataaacaaattgacattagcgatttgttcaataaaattattaatttggaacaac

SEQ ID NO: 194045 - DNA, 4043 bp, Homo sapiens
  Payload ID: 18330
  Gene Name: transmembrane protein 242
  Uniprot ID: Q9NWH2
  ENST ID: ENST00000400788
  CDS Start-End: 103-528
agattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttctgttatcatgaaaccttttattctaagggagatttttaaatgaaatgacaagaacttaatgtaatacttttctctagaccatgttaccctgttaaaattgctgtattgttaatgaaacaggtgtaatcagcatctggaattcatatgtaatctgttaaaaatccaagactgaaaggaaaggattgtgaaattggtcagtgaatgcgggtagcaaaaactcttcactgcctttcatttgtaactaaatctcctctgagaagagatctgtaggctttgaatgaaaggaaggaaaggcaggagccaaaggaacaggttttcgtccatacaattagtctgaatctaggttcctctgaatagaatgggcaccgcctgatccttttgtgcttcataaatgtgggtttccaacgtgcatgagatggccctcaaaccttgttacaacgatgcactttactcgtttgatgtggggggaaaaagaatgggcactacctaaaactgtttacagctagaatctgggttttatttttcatagatggagaatgcctagtggtttctaaaggcctccactgggtggagaaaggagacttgcccacctgtctggagtgttaaaaggagaaatcattgttaactgattctgttaatggattcctgccttgtaacctcccgaagggcagggacccctctcagggccttgtaaactggtgtcagcaccgctgcagaggctgctgcacatcaggctgatggcagctaggccctaggaaggagccaggggccatggtgggggctctgctttcccacagggctggcacagaggaggcctagacatatgttgctgaaagagtgtcctaatactagagtggcatgcctcgtgtctacaaaacccttatatgtcacctctgctgtccttgaccgatggcaggggaactcccattagaatgatgatgaatcccctgcagaggggaggctggcagggacaaattccctaaaagagggaccaagcgtcagctccaattgcatcttaaaagcaaaggtgaagtaatgcacagatggaaatttaaaaagaaaacaagcagtatgactcaagtggtgtttttcacagtcagaacttgaatatcagtagatttcgtcatttgtctattccttttgtaccagaggcatattgttaaattggttaatggaaaggaaaaatgttgaacagataatgttattctttatgagacgtaccatctgtgtattgagctctgaatgtccctggatatggaagagaggaaatgtgatggaatttcaagtttgccttctttgctgtctttatcttgggttgagtatgacaaacataatcacatttatctcctggagcataaagagttttaatcaccctattaaccaggatgacatttttcacagacttaaaaaggaatagaacagacattatctccctataagcaatccatttcatggaggctgagcactagaaatgctttaaaggatggataacgcaggccatttccatttcctgtctaagccaacattaaggaggctttcggtaaggctgttgcttccactgggtgagtgttaagctttacacttagagtctcagcgcccaaaagagctattagagaaagcacgggcagggaggagtggcttccgagaccccaggattcattcaagggaaaacatgtatcctggtaagttgctgctgccctgtgaaaaggagtccataggctgctgttatattcagagtcaagaaagtgtgggttcaggacaacctgagagtggaaagtgggggacgggagctgcctccgaagacgcccggcagcccatcaccaggaggaccatggcccaagggcatggaagcatgtggctgctgagagggtcgtgggccatctccaccaccaccctcgcgtcagggcatgggcccaggctggcgttaagggcactttgcctgcttagtcaaaaggtggcatcgaatcacctgggctgtcacatgttttgtttagtttcatggatagtatgggaccaaacttgcaaattaatcattgcaatctaaggggaaaatagaagaaattaaggtgggggtggggggacggggagcccatggggataaaagtaattaaaatccattgaatttagctatttcacttggggcaacatttaatctccaagattaaatcttggtttatggggaaggttatatattttcatctcatttttatgtatcatctttaagacaaattgttaagtacaaatgaaaatcaggtaacatacaaaggcatttcatcaaatagttaaatttcctatgaaagttagtaaaatacatatttttataataccatgttcaagtgaagtgtttttgctttctgccaagagtcattaaatgatatagcaagta

SEQ ID NO: 194046 - DNA, 1063 bp, Homo sapiens
  Payload ID: 18331
  Gene Name: transmembrane protein 243, mitochondrial
  Uniprot ID: Q9BU79
  ENST ID: ENST00000257637
  CDS Start-End: 231-587
cacttcctgcggcagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaagg

SEQ ID NO: 194047 - DNA, 1273 bp, Homo sapiens
  Payload ID: 18331
  Gene Name: transmembrane protein 243, mitochondrial
  Uniprot ID: Q9BU79
  ENST ID: ENST00000433078
  CDS Start-End: 443-799
gggcgggccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatttatacaa

SEQ ID NO: 194048 - DNA, 544 bp, Homo sapiens
  Payload ID: 18331
  Gene Name: transmembrane protein 243, mitochondrial
  ENST ID: ENST00000455575
  CDS Start-End: 530-544
ccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgaggtttggcgggcgcgggaccaatatgggcagggccgaggcgggattctccctctcgctgtgcctagaccgtactcctgctgcagttccggcagagagcgcggggagagcagcggcgggagctgcggcgagcacgccggccctgggctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgct

SEQ ID NO: 194049 - DNA, 601 bp, Homo sapiens
  Payload ID: 18331
  Gene Name: transmembrane protein 243, mitochondrial
  ENST ID: ENST00000423734
  CDS Start-End: 128-487
tccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttgtaagtactgttgagaatttaaacagtgttcttgagggtttaagttgcaatgcacaggacaaaaattttcagccttgggtctatacaaaagggtatctcttaattatatcctcatcctccccctaaaagtatgttagaattctcaataaaatctgagtcttctccttttctcctaaatcccaaagttgtaaccccaaagagaaattccactcccttgatagcttaaaaaaaaaaaaaaaa

SEQ ID NO: 194050 - DNA, 545 bp, Homo sapiens
  Payload ID: 18332
  Gene Name: transmembrane protein 244
  Uniprot ID: Q5VVB8
  ENST ID: ENST00000368143
  CDS Start-End: 84-470
cacggtgacaattgtgtcttcttccagatgtcatcgctataaggagtggggctttcatcacctccttgacgtaggatgtgtacatggctctccaggtcagagttgctccaagcaaggttgttttgcagaagtttcttctatgtgtcattcttttctacactgtgtactatgtgtccctgagcatgggctgcgtgatgtttgaggtgcatgagttgaatgtcctggctccatttgatttcaaaacaaatccctcatggctcaacataaactataaagttcttttagtttcaacagaggtcacctactttgtttgtggattgttttttgttccagttgtggaagaatgggtttgggattatgctatttcagtcactattcttcatgttgccatcacttcaactgttatgttggaattccccttgacatcacattggtgggctgctttaggtatatcaaaattgcttgtttagattctctaatgcacagaaataatgttaaatagaataactgtggaaatatattttattttctcatagattttacaa

SEQ ID NO: 194051 - DNA, 565 bp, Homo sapiens
  Payload ID: 18332
  Gene Name: transmembrane protein 244
  Uniprot ID: Q5VVB8
  ENST ID: ENST00000438392
  CDS Start-End: 182-565
gtttctaatttaagtatgagacagtaattactcatacagccagagaggattccaagtccctgcctatttgccgcactatctaaaaacaatcaactcatctttcaaatctgaccaaactacaaatgatgtcatcgctataaggagtggggctttcatcacctccttgacgtaggatgtgtacatggctctccaggtcagagttgctccaagcaaggttgttttgcagaagtttcttctatgtgtcattcttttctacactgtgtactatgtgtccctgagcatgggctgcgtgatgtttgaggtgcatgagttgaatgtcctggctccatttgatttcaaaacaaatccctcatggctcaacataaactataaagttcttttagtttcaacagaggtcacctactttgtttgtggattgttttttgttccagttgtggaagaatgggtttgggattatgctatttcagtcactattcttcatgttgccatcacttcaactgttatgttggaattccccttgacatcacattggtgggctgctttaggtatatcaaaattgcttgtt

SEQ ID NO: 194052 - DNA, 7980 bp, Homo sapiens
  Payload ID: 18333
  Gene Name: transmembrane protein 245
  Uniprot ID: Q9H330
  ENST ID: ENST00000374586
  CDS Start-End: 33-2672
cgcccctcgggggcggctgtggcggaggaacgatggccgacggcggcggccctaaggacgcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagctctggcactggctaaataagaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 194053 - DNA, 1973 bp, Homo sapiens
  Payload ID: 18333
  Gene Name: transmembrane protein 245
  ENST ID: ENST00000413712
  CDS Start-End: 1-1417
agagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataa

SEQ ID NO: 194054 - DNA, 2435 bp, Homo sapiens
  Payload ID: 18333
  Gene Name: transmembrane protein 245
  ENST ID: ENST00000491854
  CDS Start-End: 90-851
caattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaagtaagaatattgttttgaaaaagaagagagatgaatggcctagtttcagcatctgtttgcacgaaatgaccttcattgatgcagctgcattggaagataaaagataggttggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaa

SEQ ID NO: 194055 - DNA, 4223 bp, Homo sapiens
  Payload ID: 18334
  Gene Name: transmembrane protein 246
  Uniprot ID: Q9BRR3
  ENST ID: ENST00000374847
  CDS Start-End: 302-1513
agctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccggcaaagcagtcatctaatcttgaatgaaggatctgatcccagctcctgtgtcctaggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 194056 - DNA, 4244 bp, Homo sapiens
  Payload ID: 18334
  Gene Name: transmembrane protein 246
  Uniprot ID: Q9BRR3
  ENST ID: ENST00000374848
  CDS Start-End: 323-1534
gccgctttgggggccgcggtctctccgcagctcgcgggtcacatggcccgcctgagcaaggggagccctgcgcctgagctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccgggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 194057 - DNA, 5070 bp, Homo sapiens
  Payload ID: 18334
  Gene Name: transmembrane protein 246
  Uniprot ID: Q9BRR3
  ENST ID: ENST00000374851
  CDS Start-End: 1149-2360
gttggtacccctacgtgctgaaatgaagagttctggagagaatctgagggatttgaggaatttcagatgttggggattttttcccccgcacagggagcggtattctgccctgtctacacattagaatcacttggcctggacaaaagcttttttaaaaaagcgttcccctcatctcctccccccaaaccccgcatttccatccactagattctaatgcgtaagcaggagtgacaactactgcccttgtgcttttttgggaacaagaaattgtccagggaaaagataaacgccaatcagtctctgatctcagtactagtctattttaagctaattaagcattgatttttttttttaagtttatgacaaactgctattttccattcagttaaactaaatgcgttttaatgataggacggtaattaatctaacctattaatgaaaagctgtatgtctcgcagaactatgataaactacctaatgacgtcagctaagggtctagaaatggaagaatgatcgctatatcttttttaaaaaatagaatttaggcatcttgggaaaaaaagaagctaatctacactggatttctgttagtgtgaagacttttgtccctgtacctgctagggcttacctgtaaatgaagtaagatggtcaacaccagggaaacaagtgttcctggtgcctggcagtggaacaccttgactatcttggaaagaattaactggccccaagtggacttcacatttcattccgtgaagtgggagcctgagaacatattttctgtgtgaggctgaaactgttggaggcttcctgagatcattcttgagaatggagcgaccacataggggtgagcagaaccaagagaatctcagggaaatggagccaatcaactgagttaggtcacccctaacttcaacccacacttgagtgttagagaagattctacaaagagagcagacttttctagtacctttcaattctcaccataaatatagcatgttgattaagagaatggactctgaagccggatttcatcagtttggattttggcttttcctctttctagcagtttgggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 194058 - DNA, 680 bp, Homo sapiens
  Payload ID: 18335
  Gene Name: transmembrane protein 247
  Uniprot ID: A6NEH6
  ENST ID: ENST00000434431
  CDS Start-End: 22-680
ggcagcgttctggttttctggatggcagcagaggacagggagatgatggaagcccggggtgcgggagaaagttgcccgaccttccccaagatggtgcctggtgactccaagtctgaagggaagccaagggcttatctggaggcagagtcccagaagccagactcctcctatgactacttggaagagatggaagcttgtgaggacggaggctgccaagggccgcttaaatcgctgtcccccaagtcctgccgtgctaccaaaggccaggctggcgacggacccaaacccgcagagctgcccccgacccctgggactgagcgcaatcccgagatggagctggagaaggtgcgcatggagttcgagctcacgcggctcaagtacctgcatgagaagaaccagcggcagcggcagcacgaggtggtgatggagcagctgcagcgggagcggcagcacgaggtggtgatggagcagctgcagcaagaggcggcgccccgcctgttttcaggaggcctccagaacttcctgctgccccagaaccagtttgccatgttcctgtactgcttcatcttcattcacatcatctatgtcaccaaggagatggtcttctttctcttcgccaagcactacctattctgcattgcagccattttgctctgtttgattaaaactttctggtcata

SEQ ID NO: 194059 - DNA, 4229 bp, Homo sapiens
  Payload ID: 18336
  Gene Name: transmembrane protein 248
  Uniprot ID: Q9NWD8
  ENST ID: ENST00000341567
  CDS Start-End: 256-1200
acccggaaaccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggaggggggaggcagggtcttgctctgtccctcaggctggagcttagctcagtgcagcctccaactcctgggctcaagcaatcctcccactttagcctcctgagtagctgggactacaggcgtgtgccagcgcgcctggctaattttaaaatttttttgtagagacagagtctccctctgttgcccaggctggtctggaactcctagcttcaaatgatcctctcacctcggcctcccaaaatcctgggattccaggcgtcagccactgctctcggccctcttacaccattttgtttgattgtctagtccctgtttctttttctttctaatccttattcatttaagcaaaaccatacattatcttttccagtcctttcttgtattcttactgtttttttaaaataactttttgccttaatagctcattgtcactaataacttctgtgttctcccaggcagtgttataacagaagggcaatgaaaacattggacatgaccatgagtgcttcctttccttaactctaggtttgtagtctgttttaaattaggattagttcctgcattctgaaatacattggcctagaacattttatcccaggcatttttgaatagaaaacagttgcgtgcttttattgaagattgttaaaataatcaccatagtaacttgatatgttagtatttttctttttccttttagtatgtttcaagtgcagtaatcgtacttgtctatccagtttctatgtatgatacgagttgcttacacgatgcatggctaacttgttaatttagttttctccttagagactttgagacccttaagagacaagattgagaaagagccatgtggcttggctctagaaacgtcattatcattaggaccatcagattttagattaagctgctattgaattaataaaatcccaatgaagcagagttatagggatagatttatagctggcagagtggtatcaaaggagaaaaacagtgaaaaagccaatttcactggttcgttcaatccagcttgttgctaatattagttacccttgttttaatgacagagagtggctggaatctgtagctaggggaggggcaacactgttagatgtgaggaaaggaagtgccaaaaatgcctggacagatggcttgtcccaaggccaggacacacactttaaaatccaacattcacctaagcaagtaattcttaaagatcttacagaaacgcagagtcaatcaggtttataaaggaaggctgaggggagagaggaggcctgggggcctggacgaagaggcctaggacctgaagagactccagcgagtctcgggaagcccaggggacctgtcaccatctgggcacttcccaggctcaatgctcagccagagtttgctggtggacctcaggattcgaagtgtgcaacagacggagtgcgcttgctgttcagggcggccccgtgcaggagcaccagctcaccctcaggcatctcggactggagggccagcagaaggtcagcaacttactcttaaaacgattgtttcggatcatattgatctctttcctttttccttttgtcctttcactgtatgacttgaatcagttttgattctatttgtaagtgtttcttgtcgtgaggcacctgccatgtctgttgcgttttcctcggcagcgtgtagggcttcagcttcctgggttttcacccttcctgcaggcactgtggggtcctgagggccagtgggtccatttcacctcttgctgcatgatggtcagtagctgatctgttatggcattcacttccagattaattttccgtgtttgaagtatgtgcatatgtgctttacagaataaaacatctgaattta

SEQ ID NO: 194060 - DNA, 536 bp, Homo sapiens
  Payload ID: 18336
  Gene Name: transmembrane protein 248
  ENST ID: ENST00000424964
  CDS Start-End: 119-536
attctgcctgcactgctttgcggtggggcaggaagatggtttctgcgcagtgcttggggcagctgggtgctggagcttgcacagggtttctttgataccagtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaacca

SEQ ID NO: 194061 - DNA, 1610 bp, Homo sapiens
  Payload ID: 18336
  Gene Name: transmembrane protein 248
  Uniprot ID: Q9NWD8
  ENST ID: ENST00000433271
  CDS Start-End: 219-830
ggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatacta

SEQ ID NO: 194062 - DNA, 637 bp, Homo sapiens
  Payload ID: 18336
  Gene Name: transmembrane protein 248
  ENST ID: ENST00000413593
  CDS Start-End: 422-637
agaaaggtgggagggagagactcacgtacgtccacaaagttaaatggcatagtggtgttccctgtgtcaagcttggtaaatatccggaatggggtggattctttcttcatgtttttaataaaatgaggagtgatcgcaaggtaatctagaggcatgtagtttcagttcccttgatggggaccatcagaaataaaaccaggcttgttgtgctgttttgagtcgtttgaacgccgtacccatcggacagctggtgaggaggcctttgtggaagaatctgatgtctgagtttagttctcaactagcaggtgacagccctcactggctgatgaatggtgagcttctctgaagcctgctttgtaaagattgtggcttccgcctgaactgcttctttcctgcctcaaaggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaat

SEQ ID NO: 194063 - DNA, 545 bp, Homo sapiens
  Payload ID: 18336
  Gene Name: transmembrane protein 248
  ENST ID: ENST00000418375
  CDS Start-End: 264-545
gcactgctttgcggtggggcaggaagatggtttctgcgcagtgcttggggcagctgggtgctggagcttgcacagggtttctttgataccagtaagtgtcttcagctctaagtgttggataatctggcatcgcatcgatgactgttgtttactaggctcagggtttgtaaccccggccttaaagctctttgagggtctcagacatcacaggatatttgagaaatgctactttctgctacatgaaggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcc

SEQ ID NO: 194064 - DNA, 690 bp, Homo sapiens
  Payload ID: 18336
  Gene Name: transmembrane protein 248
  ENST ID: ENST00000607045
  CDS Start-End: 347-690
aaccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtgacagccctcactggctgatgaatggtgagcttctctgaagcctgctttgtaaagattgtggcttccgcctgaactgcttctttcctgcctcaaaggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctc

SEQ ID NO: 194065 - DNA, 975 bp, Homo sapiens
  Payload ID: 18337
  Gene Name: transmembrane protein 249
  Uniprot ID: Q2WGJ8
  ENST ID: ENST00000565365
  CDS Start-End: 148-855
cgctgccctgtcagtcgcctgtgagctcctgctccttcctgggcctgcagccctggagaatttgctcaccgaggtaggagtgccgctgtgggcagtgggcggcggcagcggacgagcggccaggctgaccacctctgcctgactcagatgcctaagggccgggccggcagcctgcccacgacctccatcggctggcgcttccagctctggttcctaggactcacctgcccggagcgccacctggccagacgcctcaagaacaatagcttctacccattcgtgcagcaggagccaaacgtcttcgtgctcgaatactacctggacacactgtggaaggggatgctgctcttcatcatcagcgtggtcctggtcagcttcagctccctgagagaggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttctcggtaacctcccagccccactctggggcagatcaaatgtgagtcccactcactggccttcctttcaataaagctgcctcagcttc

SEQ ID NO: 194066 - DNA, 725 bp, Homo sapiens
  Payload ID: 18337
  Gene Name: transmembrane protein 249
  ENST ID: ENST00000562477
  CDS Start-End: 79-725
cgaggtaggagtgccgctgtgggcagtgggcggcggcagcggacgagcggccaggctgaccacctctgcctgactcagatgcctaagggccgggccggcagcctgcccacgacctccatcggctggcgcttccagctctggttcctaggactcacctgcccggagcgccacctggccagacgcctcaagaacaatagcttctacccattcgtgcagcaggagccaaacggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttc

SEQ ID NO: 194067 - DNA, 1965 bp, Homo sapiens
  Payload ID: 18338
  Gene Name: transmembrane protein 25
  Uniprot ID: Q86YD3
  ENST ID: ENST00000354064
  CDS Start-End: 61-717
agttgctccggcggcgctcggggagggagccagcagcctagggcctaggcccgggccaccatggcgctgcctccaggcccagccgccctccggcacacactgctgctcctgccagcccttctgagctcagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattc

SEQ ID NO: 194068 - DNA, 2409 bp, Homo sapiens
  Payload ID: 18338
  Gene Name: transmembrane protein 25
  Uniprot ID: Q86YD3
  ENST ID: ENST00000313236
  CDS Start-End: 54-1154
ccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 194069 - DNA, 1456 bp, Homo sapiens
  Payload ID: 18338
  Gene Name: transmembrane protein 25
  Uniprot ID: Q86YD3
  ENST ID: ENST00000354284
  CDS Start-End: 64-1119
agcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccct

SEQ ID NO: 194070 - DNA, 2395 bp, Homo sapiens
  Payload ID: 18338
  Gene Name: transmembrane protein 25
  Uniprot ID: Q86YD3
  ENST ID: ENST00000359862
  CDS Start-End: 175-1143
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcattt

SEQ ID NO: 194071 - DNA, 2442 bp, Homo sapiens
  Payload ID: 18338
  Gene Name: transmembrane protein 25
  Uniprot ID: Q86YD3
  ENST ID: ENST00000411589
  CDS Start-End: 219-1187
gggggtactcggcgcgggctggggaccagccggggggtggtgagccgcggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 194072 - DNA, 2228 bp, Homo sapiens
  Payload ID: 18338
  Gene Name: transmembrane protein 25
  Uniprot ID: Q86YD3
  ENST ID: ENST00000442938
  CDS Start-End: 175-1095
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccctgtaaaaaaaaaggaaggaagggagggagggaatcaaccatgccaacaaattgatcttggactactactggactactagcctccagaactatgaaataatacatttctgatgtctaagccactcagtctatggtactttgttatggcagcctagcaaaataatacaacatgctattttttcccccgatcagtatggaattggtcatatgttttataggtaaaatacactgccatactcttttcctgtgggaatctgtgaaaaagaaactgataccaagttatgggcaagtattaacagttatatatgcattacttggtgttataatgcctaatgattccaggacaccatatgaacagagaaaatgggcatgacatctaactcaggtaacaggctctggatctaaacaagtcacagtgtgaagtttttaaactactggtttcttaaaacttttctctttttacaaaaaacagagtacatatagttctgcaacttgctgcaatttgcttttttcatttaacaacatatcactgatatttcttcatattagagcaaaataaggccaaataatattccattgcatagtatttcactgaatggatgtactgcaacctagctattcaatcccctaatcagacaccttcccctcaactacagcttcaaaatgctctgaggaaagagactgtttccaaattctgtgtgtttacaatcaattcttcatatacaaaaaaaatctgtctttgtagagcttacattttagtagggaagaacaaaataagtaaataaagtctatggtatg

SEQ ID NO: 194073 - DNA, 747 bp, Homo sapiens
  Payload ID: 18338
  Gene Name: transmembrane protein 25
  ENST ID: ENST00000526853
  CDS Start-End: 1-601
cgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgt

SEQ ID NO: 194074 - DNA, 2630 bp, Homo sapiens
  Payload ID: 18338
  Gene Name: transmembrane protein 25
  Uniprot ID: Q86YD3
  ENST ID: ENST00000524725
  CDS Start-End: 413-1381
gggaacagggcaggagagagaataggattaggagaaaggcgatccctttgggggaggggcgcgtggagtatgtgtgtgagtgtgcgtgtgtgcaaggtgtggttgcacggatgctcgttgcttctgcgtatctgcgggtgtgtgcctctttgtattgtagcctggagtcagtgctcgcttctgcgcctgcaggatgtccatgtgtctgctgggtgggtctgtgcctttgggctttgccgttcgtgtccgtgccttcgccactgggggctggtctacatttgcgtttccgtacatggttctttttgtttctggagagtaaattcctggagcaattgctaggcctgcctgctgtcacctggctgacaggcccgcccccttctctcagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattca

SEQ ID NO: 194075 - DNA, 1410 bp, Homo sapiens
  Payload ID: 18338
  Gene Name: transmembrane protein 25
  ENST ID: ENST00000533102
  CDS Start-End: 61-1206
agttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagtgaaaccagcagaccggcagatggctcagaacaacagccggccagagcttctggacccggagcccggcggcctcctcaccagccaagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcattta

SEQ ID NO: 194076 - DNA, 596 bp, Homo sapiens
  Payload ID: 18338
  Gene Name: transmembrane protein 25
  ENST ID: ENST00000525118
  CDS Start-End: 71-220
agacctgagcagttgctccggcggcgctcggggagggagccagcagcctagggcctaggcccgggccaccatggcgctgcctccaggcccagccgccctccggcacacactgctgctcctgccagcccttctgagctcagcacagtaccaaccgtgcctgagcccttcccagaggcctcctgctgtgttccaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaa

SEQ ID NO: 194077 - DNA, 573 bp, Homo sapiens
  Payload ID: 18338
  Gene Name: transmembrane protein 25
  ENST ID: ENST00000528373
  CDS Start-End: 71-573
agacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatggcttctggctacccgggtggaagtgccactgctgggcattgttgtggctgctgggcttgcactgggcaccctcgtggggttcagcaccttggtggcctgcctggtctgcagaaaagagaa

SEQ ID NO: 194078 - DNA, 586 bp, Homo sapiens
  Payload ID: 18338
  Gene Name: transmembrane protein 25
  ENST ID: ENST00000534181
  CDS Start-End: 68-181
agacctgagcagttgctccggcggcgctcggggagggagccagcctagggcctaggcccgggccaccatggcgctgcctccaggcccagccgccctccggcacacactgctgctcctgccagcccttctgagctcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggt

SEQ ID NO: 194079 - DNA, 583 bp, Homo sapiens
  Payload ID: 18338
  Gene Name: transmembrane protein 25
  ENST ID: ENST00000526973
  CDS Start-End: 1-583
agttgctccggcggcgctcggggagggagccagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcg

SEQ ID NO: 194080 - DNA, 565 bp, Homo sapiens
  Payload ID: 18338
  Gene Name: transmembrane protein 25
  ENST ID: ENST00000532762
  CDS Start-End: 61-565
agttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatgcccctcccggcacccatctctgatatcaagtgactccaacaacctaaaactcaacaacgtgcgcctgccacgggagaacatgtccctcccgtccaaccttcagctcaatgacctcactccag

SEQ ID NO: 194081 - DNA, 570 bp, Homo sapiens
  Payload ID: 18338
  Gene Name: transmembrane protein 25
  ENST ID: ENST00000533137
  CDS Start-End: 61-570
agttgctccggcggcgctcggggagggagccagcagcctagggcctaggcccgggccaccatggcgctgcctccaggcccagccgccctccggcacacactgctgctcctgccagcccttctgagctcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctg

SEQ ID NO: 194082 - DNA, 565 bp, Homo sapiens
  Payload ID: 18338
  Gene Name: transmembrane protein 25
  ENST ID: ENST00000527267
  CDS Start-End: 445-565
gatgggagagagaacagggcaggagagaggatgggaacagggcaggagagagaataggattaggagaaaggcgatccctttgggggaggggcgcgtggagtatgtgtgtgagtgtgcgtgtgtgcaaggtgtggttgcacggatgctcgttgcttctgcgtatctgcgggtgtgtgcctctttgtattgtagcctggagtcagtgctcgcttctgcgcctgcaggatgtccatgtgtctgctgggtgggtctgtgcctttgggctttgccgttcgtgtccgtgccttcgccactgggggctggtctacatttgcgtttccgtacatggttctttttgtttctggagagtaaattcctggagcaattgctaggcctgcctgctgtcacctggctgacaggcccgcccccttctctcagcagcctagggcctaggcccgggccaccatggcgctgcctccaggcccagccgccctccggcacacactgctgctcctgccagcccttctgagctcaggggggcctggcacccccagattggcctggtatctggatggacagctgcagg

SEQ ID NO: 194083 - DNA, 548 bp, Homo sapiens
  Payload ID: 18338
  Gene Name: transmembrane protein 25
  ENST ID: ENST00000533689
  CDS Start-End: 134-548
acggatgctcgttgcttctgcgtatctgcgggtgtgtgcctctttgtattgtagcctggagtcagtgctcgcttctgcgcctgcaggatgtccatgtgtctgctggcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagt

SEQ ID NO: 194084 - DNA, 909 bp, Homo sapiens
  Payload ID: 18339
  Gene Name: transmembrane protein 251
  Uniprot ID: Q8N6I4
  ENST ID: ENST00000283534
  CDS Start-End: 99-494
gcgcgcttccggcccgagccggaagctccgactgcggcggcatccgggacggcgggcgggctggccaccacgggacaggaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaa

SEQ ID NO: 194085 - DNA, 1303 bp, Homo sapiens
  Payload ID: 18339
  Gene Name: transmembrane protein 251
  Uniprot ID: Q8N6I4
  ENST ID: ENST00000415050
  CDS Start-End: 376-885
ggccaccacgggacaggaaggtgagatccgggacctcagctttgcaagcaggctccgccggcgaccgctgacgggcgctgggctcgcggcgctgcaaggcggcgaggcccgggcctggcgccgcctgcgcagccttggtcgcggcgtgccggcgctgcagcgcggcagggggcggggccggccgcccggaggcccaagtggcggggacgcctccctgccgggtcaggttctcagagcgggtctccggcggcggcgacgggggccgggccgcgcgtgacccgccgcagtcacgccgttcttaatcactagtagctggtgctccaggctggcggcgctcacctttctcctagccgggtgacccaggggatttattttatgttggctttctctgaaatgccaaagccacccgattattcagagctgagtgactctttaacgcttgccgtgggaacaggaagattttcgggaccattgcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaatta

SEQ ID NO: 194086 - DNA, 1303 bp, Homo sapiens; identical to SEQ ID NO: 194085
  Payload ID: 18339
  Gene Name: transmembrane protein 251
  Uniprot ID: Q8N6I4
  ENST ID: ENST00000622205
  CDS Start-End: 376-885

SEQ ID NO: 194087 - DNA, 909 bp, Homo sapiens; identical to SEQ ID NO: 194084
  Payload ID: 18339
  Gene Name: transmembrane protein 251
  Uniprot ID: Q8N6I4
  ENST ID: ENST00000626767
  CDS Start-End: 99-494

SEQ ID NO: 194088 - DNA, 1245 bp, Homo sapiens
  Payload ID: 18340
  Gene Name: transmembrane protein 252
  Uniprot ID: Q8N6L7
  ENST ID: ENST00000377311
  CDS Start-End: 54-566
cagggaagcagaggagcagcagggtcagggtgctgggttcctaaggtgcaaggatgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacaggccagacttttaccctccagcttatgaagagagccttgaggtggaaaagcagagctgtcctgcagagagagaggcctctggcattcctccacctctatatacagagacgggcctggaattccaggatggaaatgactcccacccagaggccccaccatcttatagagagtccatagccggcctggtggtgacagcaatctcagaggacgcccagaggcgaggccaagagtgctgaggcagagaaagctctccagcactcatgatgccaccactgtggggagcagctactgataataaaggcaaacgagggactgtgggaggaaaagccacaccagggaccccacaagagagcttggggaggggatgacagccctgaattccagacataactggccatgccagggcagggcaggccaggggccctggaagggtgtggccaacaccaagcagacatttcagagcattcacactaatcttaaccccggctggccttgggtccccaaaggtgtcactctgagagctctgcttacagagattctttctgctgtcactcaatttccctcccatcacctcaactccagccagggaggaatagatgctggttgtcaggacagccacatgccttcctgttctatatcacctagtaatctcaaagcgaaggtttgttgtttaatttattgattgttcagccttttgttttgttagcttgtttcctagttacctccagctgaccatactaccagagtgaggcagtacttcacatcctgggagatatgccctcggaacccatgaatgttattttgtattattttattttcatgatatgtattttttctatgtaaaaggaaaatgactgtaatatttgccttcaagatggttcaaacacaaaatattaaatgagctgtttcttaaaa

SEQ ID NO: 194089 - DNA, 1236 bp, Homo sapiens
  Payload ID: 18341
  Gene Name: transmembrane protein 253
  Uniprot ID: P0C7T8
  ENST ID: ENST00000556585
  CDS Start-End: 119-772
gtctgctctgagctatcaagccccttaggagacctaggacccagctgggtcccatccctttggagtagctgcttcagactagcctaggaagcacctaattcttgtgggcaaaggagccatggaagatagagctggtgagcaagagcaggagagacacagccttcgtctggaaaagctacaacactgggcaaggcacaggcagagtgggcacctcttggtgctagcggtgagccagctatggctggcagtggttgtggtgccccttgctgtctcagtcgcctgcctgaactctgattgtcacatggccacagcgctgcctcttgggcctggagcctcaggtctcctcactgggactgtcactctggagcttcgcagagcaccccgcctttggaaggtgcgggccatgatgatattcaacaccttcaacttgatcttgggtttcatagtggtggtggtcgaggtgatgaagacagccttggggcctgccccaactgcctcctcccagcatgctggcttgctggtgctggaactcagtgctgaggccttcaccctagggggagtgctggtctcagtgcacgccctattcttgctgagccagaggaaaccaggatgctgcaggagccagagtctgcactatcaagagctgcaggagggcttctctgagttggaagaggttcctggtttggagaatggtcccacggtggccagcacaggagcaaatgagagggtgggacagcgggaacagacacgtgctgctctccttccaccctgagagaatgctctccagacattcctgcatcccaccccaccaaactcagaagcttgctgggatccttcgagtccaataggaagtccgggagtgccttcagttttcactcaaagcaggcccttttttcgttccttccctgttaggggaagatacacctggacgagaatatatcctcacctcaccaccctgaaaagctgctttctcccttgcatccatatcctctcttcctgtcacctccccatacagcttcacatttgcctcatcgcacttttcttttctgtccacctttcataatcccatccactccaaatcccggaccctgcacacgccaactccctgaatccaattcaggagtgccccagttcccctttcgatccatctcctttctactgtagcggagactacaagtcccaggatgccccgctagcccgtgaccggctaggaaataaagagccttctctccgcgg

SEQ ID NO: 194090 - DNA, 786 bp, Homo sapiens
  Payload ID: 18341
  Gene Name: transmembrane protein 253
  ENST ID: ENST00000554329
  CDS Start-End: 406-786
gcgattatagagatagttaatgtcggccgtataagaaacattattaaagttactcttcggtcctttccgttcttgataaacaattcctgcgccttcctctcgaattctattttccattcctcaagtcactttaatggctcttcaatacaacaaatatttactgagtgcttactaagtgccaggcactgggctcagcgctgtgagggatgagaaagaagtggtaccttccttccaggcgattgtagtctagactacaaactgccttcctctgccaggacaagtttgtcgtctgctctgagctatcaagccccttaggagacctaggacccagctgggtcccatccctttggagtagctgcttcagactagcctaggaagcacctaattcttgtgggcaaaggagccatggaagatagagctggtgagcaagagcaggagagacacagccttcgtctggaaaagctacaacactgggcaaggcacaggcagagtgggcacctcttggtgctagcgggtctcctcactgggactgtcactctggagcttcgcagagcaccccgcctttggaaggtgcgggccatgatgatattcaacaccttcaacttgatcttgggtttcatagtggtggtggtcgaggtgatgaagacagccttggggcctgccccaactgcctcctcccagcatgctggcttgctggtgctggaactcagtgctgaggccttcaccctagggggagtgctggtctcagtgcacgccctattcttgctgagccagaggaaaccagga

SEQ ID NO: 194091 - DNA, 1526 bp, Homo sapiens
  Payload ID: 18341
  Gene Name: transmembrane protein 253
  Uniprot ID: P0C7T8
  ENST ID: ENST00000418511
  CDS Start-End: 407-1060
ggcgattatagagatagttaatgtcggccgtataagaaacattattaaagttactcttcggtcctttccgttcttgataaacaattcctgcgccttcctctcgaattctattttccattcctcaagtcactttaatggctcttcaatacaacaaatatttactgagtgcttactaagtgccaggcactgggctcagcgctgtgagggatgagaaagaagtggtaccttccttccaggcgattgtagtctagactacaaactgccttcctctgccaggacaagtttgtcgtctgctctgagctatcaagccccttaggagacctaggacccagctgggtcccatccctttggagtagctgcttcagactagcctaggaagcacctaattcttgtgggcaaaggagccatggaagatagagctggtgagcaagagcaggagagacacagccttcgtctggaaaagctacaacactgggcaaggcacaggcagagtgggcacctcttggtgctagcggtgagccagctatggctggcagtggttgtggtgccccttgctgtctcagtcgcctgcctgaactctgattgtcacatggccacagcgctgcctcttgggcctggagcctcaggtctcctcactgggactgtcactctggagcttcgcagagcaccccgcctttggaaggtgcgggccatgatgatattcaacaccttcaacttgatcttgggtttcatagtggtggtggtcgaggtgatgaagacagccttggggcctgccccaactgcctcctcccagcatgctggcttgctggtgctggaactcagtgctgaggccttcaccctagggggagtgctggtctcagtgcacgccctattcttgctgagccagaggaaaccaggatgctgcaggagccagagtctgcactatcaagagctgcaggagggcttctctgagttggaagaggttcctggtttggagaatggtcccacggtggccagcacaggagcaaatgagagggtgggacagcgggaacagacacgtgctgctctccttccaccctgagagaatgctctccagacattcctgcatcccaccccaccaaactcagaagcttgctgggatccttcgagtccaataggaagtccgggagtgccttcagttttcactcaaagcaggcccttttttcgttccttccctgttaggggaagatacacctggacgagaatatatcctcacctcaccaccctgaaaagctgctttctcccttgcatccatatcctctcttcctgtcacctccccatacagcttcacatttgcctcatcgcacttttcttttctgtccacctttcataatcccatccactccaaatcccggaccctgcacacgccaactccctgaatccaattcaggagtgccccagttcccctttcgatccatctcctttctactgtagcggagactacaagtcccaggatgccccgctagcccgtgaccggctaggaaataaagagccttctctccgcggta

SEQ ID NO: 194092 - DNA, 2074 bp, Homo sapiens
  Payload ID: 18342
  Gene Name: transmembrane protein 254
  ENST ID: ENST00000372273
  CDS Start-End: 1-434
ggacggctggggagctcccagccaactctgtgtctgggtttttcaagaggatggtgaagtcggaggccagcaatgcggctaccgcctatttccgtccagcaagacccttgccctctctggtcacagtcctggggctgggctacttcgcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 194093 - DNA, 481 bp, Homo sapiens
  Payload ID: 18342
  Gene Name: transmembrane protein 254
  Uniprot ID: Q8TBM7
  ENST ID: ENST00000372274
  CDS Start-End: 9-320
ttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctct

SEQ ID NO: 194094 - DNA, 860 bp, Homo sapiens
  Payload ID: 18342
  Gene Name: transmembrane protein 254
  Uniprot ID: Q8TBM7
  ENST ID: ENST00000372275
  CDS Start-End: 19-273
cggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaaatgagaaaactgattctgagagattctgagtgatttgcccaggtcacagctggcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccac

SEQ ID NO: 194095 - DNA, 366 bp, Homo sapiens
  Payload ID: 18342
  Gene Name: transmembrane protein 254
  Uniprot ID: Q8TBM7
  ENST ID: ENST00000372277
  CDS Start-End: 55-366
cgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcaaaatgagctaagaatacggataaagatgagaaaactgattctgagagattctgagtga

SEQ ID NO: 194096 - DNA, 2042 bp, Homo sapiens
  Payload ID: 18342
  Gene Name: transmembrane protein 254
  Uniprot ID: Q8TBM7
  ENST ID: ENST00000372281
  CDS Start-End: 31-402
gaagcgcgctcccggggaggtgttgcagccatggctacggcagccggcgcgacctactttcagcgaggcagtctgttctggttcacagtcatcaccctcagctttggctactacacatgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctctagctgaa

SEQ ID NO: 194097 - DNA, 719 bp, Homo sapiens
  Payload ID: 18342
  Gene Name: transmembrane protein 254
  ENST ID: ENST00000450179
  CDS Start-End: 1-304
agagtttcttcggtctgtgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttc

SEQ ID NO: 194098 - DNA, 2154 bp, Homo sapiens
  Payload ID: 18342
  Gene Name: transmembrane protein 254
  ENST ID: ENST00000613758
  CDS Start-End: 55-360
cgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacaccccagcagcggagtgagaccctgtcaaaaaaaaaagaaagaaagaaaatagaagccaagaatggagacccaaatgactgttcagagtttcttcgtgggttgtcttctggcctcagagtatcccttatcagaaccttgggcccctgggccccttcactcagtacttggtggaccaccatcacaccctcctgtgcaatgggtattggcttgcctggctgattcatgtgggagagtccttgtatgccatagtattgtgcaagcataaaggcatcacaagtggtcgggctcagctactctggttcctacagactttcttctttgggatagcgtctctcaccatcttgattgcttacaaacggaagcgccaaaaacaaacttgaagttgtctgaaagcttgctctacacttttacattcatcctcacccttttttttgtggggtagaggaggtgcagtaatttactcagtgatctttctactttctagaaactgtccttcaaagctctttaagaccccctcgttagtcagttttttctcttatatgctctggttgagcttgaatagaccagttgttacttaagaaagaaacagagaaagattttagcttttcaatcctatttggcagaggacttcagctaccttcttacagtctttggctgtgttggtaccctcgtgtgctctgagctaagccacatactaaactgactttttggtttgtatacccttgctcccgccttctgatgaaaacaccttaccctcacaaccaccatctttcctctcctttccaaagctctttccaccttgctgcactaagataaagtgacacttccactatatgtcaattccacacacatttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaattcaaaccagatttcttaatacctggtcttcctcaaagagaaataataacagtaatagtggtgctgggaacaatatggcagattattgaatgaaattgattaacttgaataaaatgctgtgaattttctct

SEQ ID NO: 194099 - DNA, 3394 bp, Homo sapiens
  Payload ID: 18343
  Gene Name: transmembrane protein 255A
  Uniprot ID: Q5JRV8
  ENST ID: ENST00000309720
  CDS Start-End: 125-1174
agtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggtcataagttcctcaaccaaaaattctccttccacgagggttatgaggaaccttacccaggcagctagagaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 194100 - DNA, 2879 bp, Homo sapiens
  Payload ID: 18343
  Gene Name: transmembrane protein 255A
  Uniprot ID: Q5JRV8
  ENST ID: ENST00000371352
  CDS Start-End: 103-660
catttgctatgaatattctctataacaaagcaagacaaatttagcagcacttcattgcatctggatgggggagagagctggacaatttcttgctaacaagagatggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 194101 - DNA, 3425 bp, Homo sapiens
  Payload ID: 18343
  Gene Name: transmembrane protein 255A
  Uniprot ID: Q5JRV8
  ENST ID: ENST00000371369
  CDS Start-End: 228-1205
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggaggttaactgccctcacctcagccgtgaattctgcacacctcgcatccggggcaacacctgcttctgctgtgacctctacaactgtggcaaccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatgaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtta

SEQ ID NO: 194102 - DNA, 3172 bp, Homo sapiens
  Payload ID: 18343
  Gene Name: transmembrane protein 255A
  Uniprot ID: Q5JRV8
  ENST ID: ENST00000440464
  CDS Start-End: 228-953
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaactgttctgttgaaaatacccatccaacagtttcttactatgctcatccccaagtggcatcctacaatacctactaccatagccctcctcacctgccaccatattctgcttatgactttcagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 194103 - DNA, 695 bp, Homo sapiens
  Payload ID: 18343
  Gene Name: transmembrane protein 255A
  ENST ID: ENST00000519908
  CDS Start-End: 248-695
acgcggctgcacggaccgccaatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattctcggctttggatcgttccttggaatcattggatcaaaccttattgagaacaaaaggcagatgctggtggcttctatcgtgtttatcagctttggtgtgattgcggctttttgttgtgccatagttgacggggtctttgctgccagacacattgatctgaaaccactctacgctaaccggtgccattatgttcccaagacatcacagaaggaagctgaggagaacccaactctcccagcactgaact

SEQ ID NO: 194104 - DNA, 6100 bp, Homo sapiens
  Payload ID: 18344
  Gene Name: transmembrane protein 255B
  Uniprot ID: Q8WV15
  ENST ID: ENST00000375353
  CDS Start-End: 28-1008
cccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtcacctgtcactccctggacggcaagtgccagctgaaggtgagaagcaacacctgttactgctgtgacctctatgcctgcgggagcgcagagccctcgcccgcctactatgagttcatcggcgtcagcggctgccaggacgtgctgcacctgtaccgcctgctctgggcctctgcagttctgaacgtcctgggcctgttcctgggcatcatcaccgccgccgtcctgggggccttcaaggacatggtgcctctgtcccagctggcctatggcccagccgtcccaccacagaccctctacaaccccgcccagcagatcctggcctacgcaggcttccgcctgacgcccgagcccgtcccgacctgctcgtcctaccctctgccccttcagccctgcagccgcttcccagttgcgccctcctctgccctggcttcgtctgaggacctgcagcccccttctccaagcagctctggctctgggcttcccggccaggctccaccgtgctacgcacccacctactttcccccgggggagaagccacccccctacgcaccctgatagaggcgtggagtaaaagataacttgtttgtttttttttttaaaaaaaaggcagcctctagaaatcccgcttctgtggccaacctcctagagaacccgggagaatgttccagaagtctgtcccctcctttcctccctgggcacactggtgagggaggctggaaccaggcagggagtggggccctccagacccaggctggtgacaccttggcttgggctctgctcacatcaaatggcgctgaaagttcccacccggcctcctcctctgagagcaattgttctggtgttttcacatcccttaattaattagctattattatgattttgcaaagacagtgcagccccggcctccctgcctgtgtgttcttgtttgtggacatgtgttgtgcgttacacgttcgtgtgtgcatctgtgtcctggagaagcgcagggcagaagccacccgcccctcgtgctgtgctcctgacgtatgccaggaagggaaggacgcttcggctccaacgcccagcgctgtgtctaaccgcctgtgagttgttagaatccaggggcccggttgtctttcccagccccggatgcaaatctgcctgggccactggcacgagggtcttcccctgagctgtctcccagctacggcgcctgggcttccgctgtccttccgcggcttctccctcaccgcaccttgtctcaggacccctggccgctgggatggtgggggacggtgtttcggggtcctttggctcagggtctggggccgcagcactccctgtggaaaccagcttagctccccgcgggcccagcatgcacctgccgggcacacctggggagacgggtgagcacgcctgggaagcagcaggtcccgggtgggtcacaggccccgggtgggtcacaggacaggtctcaggtgggtcacaggtcctgagtgggtcacaggtcccgggtgggtcacaggcatcccgggtgggtcacaggtcccgagtgggtcacaggccccgggtgagtcacaggccccgggtgagtcacgggtcccgggtgggtcacgggtcccgggtgggtcacgggccccgggtgggtcacgggtcccgggtgggtcacgggtcccgagtgggtcacgggtcccgggtgggtcacaggcgccccagtgacaggagttcaggatgcgccaccccaaagtagccgaagtctcttgaaaagtgttggatgtggggagaggctttctctgaactcctgaagtcagatcctcagggaaccagggactcccagggcgggagggcgggcgagaggtgatcccattgctccccagacgtgccacaagacaccaagtcgccgtctctgctctgtgggccgctcacggttccccagtcactccctctcccctcggaagctggcgcctccaggcctcaccgctctcagggcctcacgtccctccctgcaaagccccccgtgcctacgataaacaagtaccgctcttctcccgtgtgggtctgaggtctccagcttacttcacggaacagtgcccacctgggaggtggagcggggactttctcccctgcccagtcctggatctgggagaaaaaagataaggtggaggggagccacactcgtgcagacacagcctcctgccccctctgctgcccgggagcctccctctgtccgatggagggtctcacacagcctctgccccctccgctgcccgggagcctccctctgcccgacggagggtctcatcctgtgtccagcgctcctgggcagaaggcccacagcgcacatccacacatgaacggtggctggctgggcccaggggccctaacgggcctctgaaaggcctgcagccagctctggtctgtgaacccgccactgcttgtcatttttatcttataaaatccagcctcacaagcttgctgtccaggagaatgtggtcttggcctctcagggctgactggccttgaaccagtccgggaggtcgggcacgagccggaggtgcggcgtcctgtctggaaatcaccgcccagttcctccagggctgtgggtgcctggctccgagtaagaagctgaacaagcagcagagaccaagaggtttctggagcgccgggagatgcactcacgagcgcctgtgggggaagaaaagtgtgccacggatttcccgagtccccagggctctcactttacctcagggaaggctctatgggcgccgatggtgccgtggtcttgtgtgggcggttcctgggcaccctggagctcgggctgtgcccccgaagctgcctggtgcaggcaccagcacctcttggtgtcctaggggtgcgaacagcagagaagctgaactgcaggtctgggcagggagtctatgccccctggagctctggccagcaaagtcacaggaataaccctccttcccctcatgtcagccctcggtcgcagggtgcggtgtgggggcatcagagtgcttccccgaggctgcactcaccagcttcccccaaacacaacatcgatctttcccgacttttaatcttgtctagagtcaaaagctgttcaaaaatattcaactccaaggtcaacagttttgttcttgccacaaaaatgtccttatcctttatcccagccacaaagaatgtgaacaatttgactcaaggttcgtggtggctggagggtcccccaggtcccagggcagctcccacctggcgcagggctccggccaatgcctggcctgcagtgtgggcggcggctgctctcgaggtgcacctgtctcatgtggacggatcctgtctggggccaccaagctctgccagcctgagtcacggtctgatgaaccccctctctgggctccgctggggccttctgatcccagcctcctctgcagggatgggctcccaatcccgccctcacttggttcccatgcacagccgaggtcagtgagaccctggaggccgcgggagatggggtggaggggatggtggggcagggggtgctggggggtttgggggtgctgtggccccggggcagggggtgctggggggtttggggtgctgtggccccacctgcactccctgcctcactgggacagcacaggagacaggcttctcctgcagctcagaggtgggggcctagtgtagctgcaggttgtgactgaggagggcagggtcagagcattgccctgggcaggggtccgttgagactggccccaccttattagcttgggaccttgggttacagggagtctcctcctgcctcagtttctacatttcacacagcagcactgctcacaagagctcccaagcagaggcaactactgagtgggggagggacacagtccgtccacatggggccaacggccacaaagagaggaagggacatgggtgacggtccgtccacgtggggtcaccggccacggagagaggaagggacatgggtgacggtccgtccacgtggggtcaccggccacggagagaggaagggacatgggtgacggtccgtccacatggggtcaccggccacggagagaggaagggacatgggtgatatggttttgctgtgtccccacccaaatctcaacttgaattgtatttcccagaattcctgcgcgttgtgggagggacccagcgggaggtaattgaatcatggtggctggtctttcccgtgctattctcgtgatagtgagtaagtctcacgagatctgactggttgatcaggatttccgcttttgcttcttcctcattttctcttgctcctgccgtgtaagaagtgccttttgcctcccaccgtgattctgaggcctccccaaccatgtgcaattgtaagtcccgttaaacctctttttttcccagtctcgggtatgtccttattagcagtgtgaaaacagaatactacagtggtccatccacacgcgggtctcacccagccacagagagggagaggacgtggcccatccacacgcgggtcacccggccacggagaggaaggaagctctaacgggtgctgaggctgtaacacacagtgctcagggaaggacaccagacatgaagactgtgttctgtttatatgcagtgtccagagaaggcgtgtccacagacagaagccgactgggaaaggaggtgcagtcactgctcagggacacgggttcttttcggggaggcaagcgtgttcgcagcgtgttctgtatggggagagatgcagtcactgctcagggacacgggttcttttcggggaggcaagcgtgtttgcagcgtgttctggatggggagaggtgcagttactggtcagggacacgagttcttttcggggaggcaagcgtgtttgcagcgtgttctggatggggagaggtgcagtcactggtcagggatacgagttcttttcggggaggcaagtgtgttctaagcgtgttctggatggggagaggtgcagtcactggtcagggacacgagttcttgtgggaagaggagtgtccgggagccagatggcagtgatgggtggacggccccgtggatggactgaccaccgacccatgctctgcactcatgaggcgtggctattgctgtgtgaatcacatctccatggaaacgggagtgggagaaacgggccccaaggatgttgtgaagatggccttatggggctgcactggtgacttggacagtgctggccaccggccctgctcagtgaacaagagccatggtcatcaccctcgccacacagagcagctcctcctgcagacttggggaccccgtggccaccagaccccgcggtgggagcagagatgcctccgaaactctggagacccacagaggcagaagaggattccacgaggccggggcccgtcagcagatcctcagacggcgacacgcgccacttccttttctgtttcctagaccttttaactgatggaattcagtaagcagaaaacgtgcttgaaacaagggcaccatggagcggaccctccccctctcccctcgtggagtccttgaccctggggcaggtgacccttcttgctttgcaggcaggggctgtggctggagcttctcctacaaatgggctgtgctgggattagcccggctgtacatttgctttatgcttccgttggcatttaaaaatctgatgttcata

SEQ ID NO: 194105 - DNA, 694 bp, Homo sapiens
  Payload ID: 18344
  Gene Name: transmembrane protein 255B
  ENST ID: ENST00000488362
  CDS Start-End: 31-531
ggccccgggagagccgggtggggcctcgggatgcagccgccggtgcccgggcccctgggcctgctggaccccgcagaagggctttcgaggaggaagaagacgtcgctctggtttgtggggtctctgctgctggtgtccgtcctcatagtcaccgtcgggctggctgccaccaccaggacggagaatgtgaccgttgggggctactacccagggatcattctcggctttggatctttcttaggaattattggcatcaacttggtggagaatagaaggcaaatgctggtggcagcgatcgtgtttatcagttttggcgtggtggccgccttctgctgcgccatcgtggacggcgtatttgcagcacagcacattgaaccgaggcccctcaccacgggaagatgccagttttactccagtggggtggggtacttgtacgatgtctaccagacagaggtgagcaggagcactgagattcatgtgggttttgctcagctaaccccgccgaccccacgcggttttccctgcacataggcgtggtctgaatattttgattctaatagttcctgggggtcacccctgcagctggtgaaccgttgatgccccctgtgtttgggaccttgacatttcgatgtgctgtatttcactctggagtcagagttctggacttgcttcattaaatcacaacagtctcaga

SEQ ID NO: 194106 - DNA, 73 bp, Homo sapiens
  Payload ID: 18344
  Gene Name: transmembrane protein 255B
  ENST ID: ENST00000633279
  CDS Start-End: 28-73
cccgggagagccgggtggggcctcgggatgcagccgccggtgcccgggcccctgggcctgctggaccccgcag

SEQ ID NO: 194107 - DNA, 76 bp, Homo sapiens
  Payload ID: 18344
  Gene Name: transmembrane protein 255B
  ENST ID: ENST00000631591
  CDS Start-End: 31-76
ggccccgggagagccgggtggggcctcgggatgcagccgccggtgcccgggcccctgggcctgctggaccccgcag

SEQ ID NO: 194108 - DNA, 486 bp, Homo sapiens
  Payload ID: 18345
  Gene Name: transmembrane protein 256
  Uniprot ID: Q8N2U0
  ENST ID: ENST00000302422
  CDS Start-End: 54-395
ggcctcttgggtggcctgggcggcgttggtccggtgcgtcctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctctgagtggagaccccagcatccagactttggcccctgcgggagggaccctgctactcttgggctggcttgccttggctctttgagctcccttttgcttaattactgggttttctgggcagttttttttttaaagagttggagtaagaagaggattaaaaaggaaaggcaaataaa

SEQ ID NO: 194109 - DNA, 511 bp, Homo sapiens
  Payload ID: 18345
  Gene Name: transmembrane protein 256
  ENST ID: ENST00000576017
  CDS Start-End: 1-81
ggagctgcggccttaggcttcgcttcctacggggcgcacggcgcccaattcccagatgcctacgggaaggaggtgaagtaactgcgctggggctccctgactcctgtttgacaaggccaacaaacaccacttcttacacagcctggccctgttaggggtgccccattgcagaaagccactctgggtaatctttccctgcgcctaaccctgaccaagccccacacactccctctcagcctgccctgttcttaacaatcctgttttctgtgctgtgtctccttcaggctgggttattgctagcttccggaacgaccttattctgcaccagcttttactaccaggctctgagtggagaccccagcatccagactttggcccctgcgggagggaccctgctactcttgggctggcttgccttggctctttgagctcccttttgcttaattactgggttttctgggcagttttttttttaaagagttggagtaagaagaggattaaaaaggaaagg

SEQ ID NO: 194110 - DNA, 2441 bp, Homo sapiens
  Payload ID: 18346
  Gene Name: transmembrane protein 257
  Uniprot ID: O96002
  ENST ID: ENST00000408967
  CDS Start-End: 269-604
gtgattccacttcagtgttcatttttatttttctgaaagtaaagatactcctgtaaaatgccattgtccatagaaaaaatattaactcattaagtttaaagacagatgataccttaatattaacttacttacacgattttaaagacgcctactgagagaactcaaatttataaactctgttgcctaataattatggtttaattctatatcctcttgcttgttacagttatacttaatttgcagtagatttttaaatgaaattatttgaatgtattccagactattttatttaaaatcatcatacatcatatactttgaacctttattttctaatgcaatcataaacattttaagttttattaactcactagcatccccactgactatattctgttttgctttatctgctcaagcactttcgaccatattttattttaggatttttatttttatcttccacagctggatattgctatttcacttttatttcacatgcagctttaagacgtatgagcatcagcacagcaaaatggttccagcctacagaatgcagtctcccagggccctgccaagaacatatctgtatgtctggccctacaaatgacaaatggtaattcccttctattttagctcttaattagttgctttcactatttccgaatatacctgtggctaagtttttattgaaacactcaaaaataccacttctcagtatgaacacaattgctaagagcctaatttggttctggactatggtcaacctgtgtgccttgttagttctctccagcagctggtgagtaaggaaatgacccttcaatttcctcttctttttcctctgacctctgtgacttaatttttcttaatgtctccaagtcatcaagggcttaataatttatgaattttacaaaaagcatttaaggaataagaaagaggttctgtgatttttcagactctgaaaattcattttgattctacatattccagaaatatactgggttggatgctagagtgaagaaagccgtccagacaattctcccagtccattcatttcttcattcatttgttcattcagtagttattgagtgcttatttcctgggtgcctggctctaggctatgtcctgagacatacagtggacagggtctctaccctcctcacaacaccctcttcaccctccacgccaccccctactactcactctcaccctagcaaggagcttcgtgctaataagagagagtcttacctgaatggcaatcgcccagattaacagtggagacagtaatgcaatgcaggaagttaagtttttaaaggtgattctgtgcagtaaggtataaaacagatatataataaatagcctagcttagtctaacatctctttagaattacacagctaaaaaggaaaaaaaacaccaaaataagataaaataaaacaaatttaaacaccaaaataagatataataaaacatttgtttttgcaaaataaggcccaatgttatggcctaatgaaagctatatacttgtgctatctaaagcactactttgtaaagatgactacccaagattgtaaatacaaaatttaaaaaggtacttaaattttctggaatatccatgtttcagaggtaatatttactttctatttcagtggcttaaattataacgttttggcttaagtgtcttttatcaatacaatgataagacaccttaatcctgagagagaaaattaagtactgtatataggtgtactttgcttctcacaatgattgtgcaaaaagtcacgtgtaaattgaacttttgtaaatcaaattgtattttaaatgcattaggggagctgccatttagaggaaacttgtgaattctttcataaagcagaaaaccattttataatacaaataaccattctctgatttatctcttttgtatgtttggattttcaatatcgactttgcttaaaacagagcccacctgcatagtaactgtgttttgccaaggctgcttgtgctaccagtttgctggtggctaacggcttgtgcttgaaagtcttctgaagtctgatgtgaattgagctatcaagcaatgctatcatagcacagtagcagtcctgaacagtctgagcagccaacccatttcaacaaaattgaacacaggactcttctgctcagcagcatctcttttctcagatgtggccatgttacagtagagggtattccataagcacatattccataaagtgctcagagtcacaggttttataataaattatgttattatgtaaacgaattgcatgcatgttgaaattttttagcagtactttagcttgaaagtactcgtacaaatactgttagatttagttgcaaataattgttctcaagttattgcaataaatgtcaaatgaaacaagctcttgtgtaaatagacttctgtgcctaatagtgacattgtttc

SEQ ID NO: 194111 - DNA, 468 bp, Homo sapiens
  Payload ID: 18347
  Gene Name: transmembrane protein 258
  Uniprot ID: P61165
  ENST ID: ENST00000257262
  CDS Start-End: 44-283
ttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtaacaaccagatggcttcactgaaacctgcttttgtaaattacttttttttactgttgctggaagtgtcccacctgctgctcataataaatgcagatgtatagca

SEQ ID NO: 194112 - DNA, 395 bp, Homo sapiens
  Payload ID: 18347
  Gene Name: transmembrane protein 258
  ENST ID: ENST00000535297
  CDS Start-End: 59-208
gctcctgccgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaacaaccagatggcttcactgaaacctgcttttgtaaattacttttttttactgttgctggaagtgtcccacctgctgctcataataaatgcagatgtatagca

SEQ ID NO: 194113 - DNA, 517 bp, Homo sapiens
  Payload ID: 18347
  Gene Name: transmembrane protein 258
  ENST ID: ENST00000541893
  CDS Start-End: 23-172
ggattagccttcgcggggcaaaatggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagca

SEQ ID NO: 194114 - DNA, 575 bp, Homo sapiens
  Payload ID: 18347
  Gene Name: transmembrane protein 258
  Uniprot ID: P61165
  ENST ID: ENST00000537328
  CDS Start-End: 53-292
gccgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcagtcctgtctggggcccattctgcaggggtggtgggtgctgggacctacattgcttccccaatctcttccctttcccatttctcatctgcctttcacagttcctgctgctgatctacttaagggggatgagatttgtgtagcaccggtgttttgtcattggaatttaa

SEQ ID NO: 194115 - DNA, 1692 bp, Homo sapiens
  Payload ID: 18347
  Gene Name: transmembrane protein 258
  ENST ID: ENST00000543510
  CDS Start-End: 1353-1577
gtccctccagggagaacagagtctctcagcgaccctggcgtacccttctccaccgcttgtccccactccacccacaccaggtccccgcaggcccctgctccctctacacccgaaatcgcaggactacaagtccctcaatgccacttgcgccggaggcacttccttttccggttgtgctaggcgcctgctcctgccgacgtgttcttccggtggcggagcggcggattagccttcgcggggcaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaagggggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagc

SEQ ID NO: 194116 - DNA, 579 bp, Homo sapiens
  Payload ID: 18347
  Gene Name: transmembrane protein 258
  ENST ID: ENST00000545210
  CDS Start-End: 37-186
ggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagca

SEQ ID NO: 194117 - DNA, 2581 bp, Homo sapiens
  Payload ID: 18348
  Gene Name: transmembrane protein 259
  Uniprot ID: Q4ZIN3
  ENST ID: ENST00000333175
  CDS Start-End: 120-1346
ggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggc

SEQ ID NO: 194118 - DNA, 2748 bp, Homo sapiens
  Payload ID: 18348
  Gene Name: transmembrane protein 259
  Uniprot ID: Q4ZIN3
  ENST ID: ENST00000356663
  CDS Start-End: 184-2046
gggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggctca

SEQ ID NO: 194119 - DNA, 626 bp, Homo sapiens
  Payload ID: 18348
  Gene Name: transmembrane protein 259
  ENST ID: ENST00000586285
  CDS Start-End: 1-626
gcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcg

SEQ ID NO: 194120 - DNA, 2509 bp, Homo sapiens
  Payload ID: 18348
  Gene Name: transmembrane protein 259
  ENST ID: ENST00000592590
  CDS Start-End: 8-1273
ctggagcatgtgggtgcctgctggggagcctgggtcagggacagggtcatggagtgtaggggactggaccacccagggcatgcgagtggctgagccaggttgcgggcagagggtggccaggggcccatgggagcatttgcaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgcgcccctgctgaccgtcatcctggccctcgtcggtgaggaccccacccggcctcccccgccccgcgctgcaccccgccccgcccgcttcaaccggcgccgcctctccctgcagggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggct

SEQ ID NO: 194121 - DNA, 1965 bp, Homo sapiens
  Payload ID: 18348
  Gene Name: transmembrane protein 259
  ENST ID: ENST00000593068
  CDS Start-End: 1-616
agtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggtgaggcctgggcggcaagcagggggcaggccagccgtgcctttccaggcaggagaggctgcagccggggaggatgccctgtggggtcggcccaagcgggcagagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggctca

SEQ ID NO: 194122 - DNA, 418 bp, Homo sapiens
  Payload ID: 18348
  Gene Name: transmembrane protein 259
  ENST ID: ENST00000586250
  CDS Start-End: 1-418
gcggccgcgggagcttcccgggcctggccgtggaaccaggcagcaacctggacatggaagatgaggaggaggaagagctgaccatggagatgtttgggaacagctccatcaaggtccctggtcgcccacagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacat

SEQ ID NO: 194123 - DNA, 518 bp, Homo sapiens
  Payload ID: 18349
  Gene Name: transmembrane protein 26
  ENST ID: ENST00000277749
  CDS Start-End: 1-510
tattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggaatagtcctgcactagtctatgccatccttgttatatggacttggagcatgctgcagtttccacttgacctggcagacccatgtattagaacttcagaagacataggagcagttaaaattgtcctcattggaggtccttggaatcctactggtcttactttaataaaaacataaacccctaa

SEQ ID NO: 194124 - DNA, 5151 bp, Homo sapiens
  Payload ID: 18349
  Gene Name: transmembrane protein 26
  Uniprot ID: Q6ZUK4
  ENST ID: ENST00000399298
  CDS Start-End: 370-1476
acagaggcccgggggcggggataccggacagggatggagactggccccgagattgggagggggatgggcagcgctggagaataacgccctggagacagggcagcgcagccccagactccctggaaaacccagcagtctggaaaagctgggtttggactcacccctctttgaagagttctcaggaagtttgggggaggggcgagccgcgcaccagttctaccggcatcgggcgctgagggtgagaagggaccacaagcagcagcaggtctcagtgcttgtcatattcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggaatagtcctgcactagtctatgccatccttgttatatggacttggagcatgctgcagtttccacttgacctggcagtacagaacgttgtgtgccctgtgtctgtgacagagaggggattccccagcctgttcttttgccagtacagtgccgatctgtggaacatcggaatcagcgtcttcatacaagatggccccttccttgtcgtgcgtctcatactgatgacctatttcaaagtgatcaatcagatgctggtgttctttgccgcgaagaacttcctcgtggtggtgttgcaactctaccgcttggtggtgctggcattggcagtccgtgcttcgttgagaagtcagtcagaaggcctgaaaggagaacatggttgccgggcacagacctctgagagtgggccctctcagcgggactggcagaacgagtctaaggagggcctggctattcctttgcggggctccccagtcacctccgacgactcccaccacaccccttagttattgattgacagtggtctgcggctagaacctgactccctggttcttcttacagggaggatcctttttctcctccaaccttggcgtataataattttcaaaagaacaacataaaaaggtgatcttaaaccaaagctgaggaattttcttttttcaactgaatagaaggaactttgattagtgactattgctacaacttctgtgtgatggtatcagatgttatagttgttcaacgactaagtgatttgtttgtcttgaactgtttgaaaagctatggaagaggttacagtgacatgccctcgaaagatttggtgcagaccaactgtcgcggctgttacctggaaatagagaagctttgaactttgcctccattgtcagactatttcgtctgatcttttctgcaatgttcctctgacatcaaaaaatgtacattcagtgaatgcagaacaaatgaagggaaaagtgcctttaaaattacctcactgtgggctggaagaagcgaaaatctctgcccagcttccgtatcatagagagccctattcatcgctgcccaggccttcccaggaaaatcattttttctgggctgatgttgtattctgccatggcgcatatgttcttacagaaattttattgcttttgtcttgggtgctacaaaattcacagcaagccattttggttacatatctactggttgcaaggcaggaaatattggtgaaatgctagcaaagtcacaatttctactctgaacatgatttgcagtgttcatcagtatttttctgaaccctgctttaccattttctatattgccaagttgaatcatgtgggctgatgcagggaagctctgaagcagtgaataaaggtgtttcgggccctgtaagtgtttccatggtttctggtgtctgccagcagtagtgaacaaagctgcagcttctttgaaccgcgactactggaagtggcctttgctctcagggaacatggtgatggagggttgcatcagctccacccatggccaacagcccttgttgagtgacgggagtcggaatgtgctaccccgttgtgggaatcaggcaattcgctttattttcttgcattaagacttcattttcccagtattgaaatagccatacttttcctttacatacctctatactttccagatggaggtgattcagaaccttttaaagtgatttttgcctttaaagatacagtgtgaaaatttgctcgggtgtgtagcagtaattacacgaggcaaacagttccaaaactgttcttttaggttcaaaacctaattcccccagattagtatactcgagaattcaaagggacatttaaggtggggtatgcccttaatttggtatgacttattgacaaccagttgggacaattttatctgtaactctctgggtgacatgatacctattcgaaacattttatacaaacttttatagacaaattgtgtttttatacagagtcatgcatattttctcataaatggcttcttcagtgccattgttatatgttttttatttctttcttccttgtgcttctaattttaacaatataatgactataaaatgacacatggaactaatggaatacatttatgattttccataataattttatgaaagttaagatcaagaaattatatttatatgaagtaaatcacttgacaacttttaagggcatgttatttgaagtgctcagcagttgaaagcaaaataataactgctatttataaaaatgcctcagcagaatctgtttttatgttgactgctttatgttgaatattttcttccacaacatgtatgtgctgcttattattgcagatttgctcatggcatacttttcatgttttaatttttttcttccagcaaaataaacactgaggccctaaaaatagataaagtataaagtagtacggctgttgcaaggatatttttaaatgctttcaaatctgagacttggcttggcttcgtgaatgagtttctagtgtttaaattaaagtattttgtaattagactcctcgtgggcttgagaaataaaaagcctgtccaaagtctagctttatttagagggtcaggaagtcaaagagcacccaggaccatcttggcaattaatagcggcaaaaatagacccagcttctgcaaggttttccaggaaaatctgcttggggcagcatttgttaacctagctgccagtactcctactctcttatactggctgcttttataataggaaaaaaaaatatgcatttgcttagtttatttgaataaaagctctaaacctaggttatatattagccattcctaagactcctgattaaatattacaaatttgttcagttcatagcgtagactgctaaatactgtaatgtttcaaaacatccaactgtttgttataaagtggctagaacatcaattacctcccatgtgtggacatcctgggacttgtttacattttatctgtaataagataactgactcacaacacctgtataatgtgatgcaagtcatcctctctatcataacccctccccccaacacacagtaggtcactccccaacccctgaagaaagtggcttatttgaggttgttggtgctgttggtattattgccatagttgttatttaattgcttgattaaactcagtcaaatatccttcctaaaaacatgtcattccacttgtgaaagaaaacacaatgtgcatgtttcaatgatactgtgcggaaacacacctcatgatcatcttgtgggtttcttttgcccttactggatgactctcagaggacatgacttgacatagtaacattagtaaactgtctttatctttgattattcttttaatttttatttgagctgtttcaatagcataatgaaataaaattttgaattggccaataacatgctttataatcttccagtgaagagtctgatacaaatttactcttggcactgttgtagttccactaacaaatagcacttcagaccttatagaaccatatagatatggccaaggaatagcaggattcactattataatactaattgttaactcattatttaattgaacatttccaaagctctggaaaggcatgcatttgtaggtgcacatgctttaagatttctatccatctttcagagttgaatgtaataatgtttggtatttaattcttgataattcttaaccaacttttcctgttacaggagagaaagaattgcaaatgccaggcatctgtccactttagccctcctccaatgctaagaaagagggatggtgacgtatactacagagacgcaaatgaaacaccaaacagtcttgaattacaagaaaaaaaggggattttttttttttctaatttcagacttggctttttacttagaggacattctgatttgctctcagaaacatctgatttggggttaaactaggcggctggaggatgtttacagctttgaggcttcaaataagtttccatatgcagggagtaactttaaacaatgtttgaataattaactgctaagtcttatattttatgtgtatctatttcatcctctgtctctttcttactagaataccatataagaatattttctctgcagtatttatatttatactattttgctatgagtggcctttgtattttattatatgcattaaatagtgtgtgcacaa

SEQ ID NO: 194125 - DNA, 2610 bp, Homo sapiens
  Payload ID: 18349
  Gene Name: transmembrane protein 26
  Uniprot ID: Q6ZUK4
  ENST ID: ENST00000503886
  CDS Start-End: 158-1264
agttctaccggcatcgggcgctgagggtgagaagggaccacaagcagcagcaggtctcagtgcttgtcatattcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggaatagtcctgcactagtctatgccatccttgttatatggacttggagcatgctgcagtttccacttgacctggcagtacagaacgttgtgtgccctgtgtctgtgacagagaggggattccccagcctgttcttttgccagtacagtgccgatctgtggaacatcggaatcagcgtcttcatacaagatggccccttccttgtcgtgcgtctcatactgatgacctatttcaaagtgatcaatcagatgctggtgttctttgccgcgaagaacttcctcgtggtggtgttgcaactctaccgcttggtggtgctggcattggcagtccgtgcttcgttgagaagtcagtcagaaggcctgaaaggagaacatggttgccgggcacagacctctgagagtgggccctctcagcgggactggcagaacgagtctaaggagggcctggctattcctttgcggggctccccagtcacctccgacgactcccaccacaccccttagttattgattgacagtggtctgcggctagaacctgactccctggttcttcttacagggaggatcctttttctcctccaaccttggcgtataataattttcaaaagaacaacataaaaaggtgatcttaaaccaaagctgaggaattttcttttttcaactgaatagaaggaactttgattagtgactattgctacaacttctgtgtgatggtatcagatgttatagttgttcaacgactaagtgatttgtttgtcttgaactgtttgaaaagctatggaagaggttacagtgacatgccctcgaaagatttggtgcagaccaactgtcgcggctgttacctggaaatagagaagctttgaactttgcctccattgtcagactatttcgtctgatcttttctgcaatgttcctctgacatcaaaaaatgtacattcagtgaatgcagaacaaatgaagggaaaagtgcctttaaaattacctcactgtgggctggaagaagcgaaaatctctgcccagcttccgtatcatagagagccctattcatcgctgcccaggccttcccaggaaaatcattttttctgggctgatgttgtattctgccatggcgcatatgttcttacagaaattttattgcttttgtcttgggtgctacaaaattcacagcaagccattttggttacatatctactggttgcaaggcaggaaatattggtgaaatgctagcaaagtcacaatttctactctgaacatgatttgcagtgttcatcagtatttttctgaaccctgctttaccattttctatattgccaagttgaatcatgtgggctgatgcagggaagctctgaagcagtgaataaaggtgtttcgggccctgagagaaagaattgcaaatgccaggcatctgtccactttagccctcctccaatgctaagaaagagggatggtgacgtatactacagagacgcaaatgaaacaccaaacagtcttgaattacaagaaaaaaaggggattttttttttttctaatttcagacttggctttttacttagaggacattctgatttgctctcagaaacatctgatttggggttaaactaggcggctggaggatgtttacagctttgaggcttcaaataagtttccatatgcagggagtaactttaaacaatgtttgaataattaactgctaagtcttatattttatgtgtatctatttcatcctctgtctctttcttactagaataccatataagaatattttctctgcagtatttatatttatactattttgctatgagtggcctttgtattttattatatgcattaaatagtgtgtgcacaacttt

SEQ ID NO: 194126 - DNA, 2520 bp, Homo sapiens
  Payload ID: 18349
  Gene Name: transmembrane protein 26
  Uniprot ID: Q6ZUK4
  ENST ID: ENST00000488505
  CDS Start-End: 87-758
ttcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggctctgttggaaaaattccactaatagaagacatactaaccccaagtggcaacttgttctattttgagggtactggttttctatccacgttctatgccatatgtgcatgtgagaagccttccatcaatgtccaccaagtcatgataaaatgtgaagtagaaaagaatcaaaagcacagccttcaacaacccattggagagtccccctgtggggagccatttacacaggaatccacctaacagtattcacacctggaatatttcttaattttgttaatgaggacactatgggagactttttcagaagccttgtttaaatctgaatgtctgtcatcaatttacataacattacctgcttggtaatcctaactatattttttaagaggaggaactaagtttaattgagtgcaatttttctcagaggacctgtgctgatgcttcgtaataactgtgttcttctaaaagggctctcagaaatcttttaaaggatcatttatataatctaactagagattaatagtaaatgtgccttttgtacttcaagacatatttctgcttcattttgaaagttgagactttatttttttatcaccaaccttgtctccaccattaactgccaagacagataatgatggtttagaaatctcatttacaaattctctcagagttttgagatttaattttgtatttaatgcctctacacttgaagcatttaaagatatcccttacaatcacctcatttcttttggtttcaattactcctccttgatgcttttcagacctcttcaatctgaaaatctcttttgatggaagatggaaacaaaatctattattatgctaccaagctcaaattgatgacttcctttctatctttgctaaaaataaatgtgaccctgtttaatatcctttgcatttctgcaacctctgttctttctgattttagccttcatgaccattttcctaggtctaggacatttgtatatttgtctgagtatggacccttctttggtgcttttaaccattccttccataaatatatgttgtatccatcaagcactgttctaggcactaaggatacagtggtgaatgaaataggcttattccttgctttatgtcctactatctggtataaatctttgtttattggatttatctccttacctttttcctatctaatgacaattttatttcaatgttgagtttttaatctttgatcatcatttagctcttttgaaatgtcttttcaattcgatccctggtttcttagaataattattaatcctcccactgacattccttgaaatcagccatttgaatatccatgttaatatctatattttctcccctatcatttttctcccataatgtttccataattttgtaaaactaaagacagcaatatgggaccaagaggctttgtcataattcatgcatatgttgggctttaagtctcagattatttatttttcacttcttcattattccattattatcatgtaaggatttttttcattgatttattaaatcaccaagatattttggccacaagaggtttattaggaatatactaaaaaacttgactgagaagacttttctgcatgtgatcatactttttattacaaatttaacattttgtctgtattctaggaatagtcctgcactagtctatgccatccttgttatatggacttggagcatgctgcagtttccacttgacctggcagacccatgtattagaacttcagaagacataggagcagttaaaattgtcctcattggaggtccttggaatcctactggtcttactttaataaaaacataaacccctaa

SEQ ID NO: 194127 - DNA, 4264 bp, Homo sapiens
  Payload ID: 18350
  Gene Name: transmembrane protein 260
  Uniprot ID: Q9NX78
  ENST ID: ENST00000261556
  CDS Start-End: 123-2246
ggctcgacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggccccttaccaggaatagtcacagttccgtggcattgtactagcaaaagggtctgatcaaaggtctcctgtggagcttgcatggttccctttcatactacgaccataattaaaaccactaattctcttttaaaatgctgcaggatgccatgtaggcatctgtctggagtgtcctttgtgatgtcataagctgttaaggaccagtgccgagggcttttgagtgaaatgccagtcatgaaggtgcttcaagacaagggtgcctctaaaagcttgacagggccttgactgcacaattcgagctgaatttgccccttgtcagctgccagtaaataaatctcaaagggggaaaagctgaagtttcattacctgatccatggggctttgttggttttggcatcacacaggggaagctcttgcccctccattctctggatttgaagatgtccattggagcctgcagtgcctggacagggttcagagcggaaccttttgaagagtgtcaatagttgtaacagttcagctgttaggaagacaaataaatggaggagctcattaatccgcttttggctctcagtgccttttgcccttttatcacagccttattaggctcctactcatcttgaaccagaaaaaaatgaattgaagttgttgagtactaattggcaaagacttttaatcatgggccaagaactttcactgacttgaaagtaacttctccacagggaaggaccaaaaacctggtttaccttaaaacaaaaacctgttggagttcagcgtggtgtaaaaatgtaaggaagcattgataaattgtctaagtttatccatttgaaagaaattgtgtaagattatgatattctcttttctttaaaaaaaaaagtacaataaaattcaaacattccttaggaaa

SEQ ID NO: 194128 - DNA, 1638 bp, Homo sapiens
  Payload ID: 18350
  Gene Name: transmembrane protein 260
  ENST ID: ENST00000538838
  CDS Start-End: 32-1261
cgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgagg

SEQ ID NO: 194129 - DNA, 2680 bp, Homo sapiens
  Payload ID: 18350
  Gene Name: transmembrane protein 260
  ENST ID: ENST00000539559
  CDS Start-End: 75-1049
ctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaagtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagtgtttgtgaccaaaggaccaactatgtgattgataagttcgcaaagaaccttctcacctctatgcctcatgatgcaattatcttactcagaggagatttgccaggaaattctctccgttacatgcattactgtgaggggttgaggcctgacatttcattagtggatcaggaaatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaa

SEQ ID NO: 194130 - DNA, 3864 bp, Homo sapiens
  Payload ID: 18350
  Gene Name: transmembrane protein 260
  ENST ID: ENST00000556422
  CDS Start-End: 363-1124
gctttttaaagggaatgctctcctggtgattaggaaccttaaatcacattataagggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggctttctggctcatctgctggaggaatccttgctgcgggggtgttttcattttctcgtctaacatggcagtggtccattgcagcagaggtttttagcttaaacaatctctttgtggggctgcttatggctcttactgtacattttgaggaagcagcaactgctaaggagagatcaaaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgcttattgggatcagttttaaagttaaattcttttgatattaataccagaccaaagacattttctgtttcctggaaaaaaaaaatgaatcatgttaggctttaggtgagagtacattttttacaaagtagctatagttgttacatagtcttacacttcaagctaaacaccaaatgggtgatattttgaaaaaagtttgtgttttactgtcttagatcgttcttggaaatcactaaaaaaaaaaaaagttaatttgatgtttgcttatttcagttgcagaaactggcgagtaaaaaagattttgcatttacttaattaattttatatttatgttttatttctatttggactcagagatctagacccaataattagtaggctcctgctgccaaaatgcaaaggggaaaaaaaggcagggattgggggggatggggaagtggcccaataaattcatttctgttacaagcatcttttatacatattactaaagagaacatagtaagaaatgcaaataatagttctttattttattatgacagttaattaatagcaacctgttttaatgaataaagtcactcagagtccttcagcacttcctaagtagaggccagaatctgtagggcttcttttccccccaattgtatagctcctagactccaagcactatataggcccctgtatagaaatgctcactaatgaagagggagggctagaagcttgtctgcattcaaagatcactggtgagtcattcagcaagaaaaggccccttaccaggaatagtcacagttccgtggcattgtactagcaaaagggtctgatcaaaggtctcctgtggagcttgcatggttccctttcatactacgaccataattaaaaccactaattctcttttaaaatgctgcaggatgccatgtaggcatctgtctggagtgtcctttgtgatgtcataagctgttaaggaccagtgccgagggcttttgagtgaaatgccagtcatgaaggtgcttcaagacaagggtgcctctaaaagcttgacagggccttgactgcacaattcgagctgaatttgccccttgtcagctgccagtaaataaatctcaaagggggaaaagctgaagtttcattacctgatccatggggctttgttggttttggcatcacacaggggaagctcttgcccctccattctctggatttgaagatgtccattggagcctgcagtgcctggacagggttcagagcggaaccttttgaagagtgtcaatagttgtaacagttcagctgttaggaagacaaataaatggaggagctcattaatccgcttttggctctcagtgccttttgcccttttatcacagccttattaggctcctactcatcttgaaccagaaaaaaatgaattgaagttgttgagtactaattggcaaagacttttaatcatgggccaagaactttcactgacttgaaagtaacttctccacagggaaggaccaaaaacctggtttaccttaaaacaaaaacctgttggagttcagcgtggtgtaaaaatgtaaggaagcattgataaattgtctaagtttatccatttgaaagaaattgtgtaagattatgatattctcttttctttaaaaaaaaaagtacaataaaattcaaacattccttaggaaa

SEQ ID NO: 194131 - DNA, 662 bp, Homo sapiens
  Payload ID: 18350
  Gene Name: transmembrane protein 260
  ENST ID: ENST00000556810
  CDS Start-End: 440-662
aataatttaacctatgtcttagtttcatctagaaaatagagatggtagattgcaggtttgttgtctttaagcaaatgaatgtatctggaacactagaacatagaaaacacttagtgaatggcagctacatcatcatcatcatcatgatcatcatcgtcatcatccccaagtttagctgggagagtttgcttggctgcttcatagaagaattgcaatctggcttgccccaacatgtataggtctgcctcgtggtaagaacagcgagagtgactaagctccagtgataagggcaatgctgtttcttgagcctgctgcagcacctgtcatgggaggcagagagagcatgcaaatccctcaggcccatgtctgttcaatgacaaaaggaaggaggatgcactattcccagtgacctcaagatggcagtggagaaatactccaaatgaatttcctgaggtcaccccccgatccagcgaaggaccactgtaatggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttca

SEQ ID NO: 194132 - DNA, 618 bp, Homo sapiens
  Payload ID: 18350
  Gene Name: transmembrane protein 260
  ENST ID: ENST00000555046
  CDS Start-End: 1-125
caccgttcttcatctttaacctggcagaaactgctcacatgccttcaaaagtgaaagctcaactctacgctcaagcatatgactgtacagactccataaaatctgataaaaggggtttcctgtagtctgacccccgacattgaggagactgtaatggaggtgacttctcatgcaagatttggccagcgttctagcagtgtcccgggagtgccatggtttggcaggaagacaggaaccccacaaggccaacttctgcctggacttcggcctgaagagccagtgggagccagtgaaactgtctgactctccacatgcgtcagggccctgccgccctggcaccaaggctggcacgcaccagagggcaagtggagaagcggatggtggctcccatgttatctgactaaccactgggtgggctacactccctgtgcccccgctgttgcctctgataggagtatgcttggttcttggtattgacttgcctttttttgttgttttttaaaagcacccattttgttcaatgcttctgttctgttactcaaaatgtagccaaaatagaagggaatcaattactagtgtattattttgaaagcttcaaacagaaattgtgaaatgtta

SEQ ID NO: 194133 - DNA, 2218 bp, Homo sapiens
  Payload ID: 18350
  Gene Name: transmembrane protein 260
  ENST ID: ENST00000555497
  CDS Start-End: 90-437
aagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgcccccttcggtaccggggggagactccggggaactgatcacagccgcacatgagcttggagttgcccatcctcctggctatcctttgttcacgctggtggctaaactggcaattacactgtttccttttggttcaattgcctaccgcgtcaatcttctctgtggcttatttggagcagtagctgcatcattactttttttcaccgttttcaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaaggacagacagaatccatcattagtatggctttttactggaatgttttgcatttattcattgttctttgcttggagagcaaatttagatatttcaaaaccacttttcatgggtgtggtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaaggtttgatccatcttcttgggaatctgtggccaatgaagaaatgtggcaagcgaggatgaaaacaccgttcttcatctttaacctggcagaaactgctcacatgccttcaaaagtgaaagctcaactctacgctcaagcatatgacctttataaggagattgtctatttacaaaaggagcacccagtgaattggcacaagaactatgccatcgcctgtgagcggatgctgcgtcttcaggcaagagatgcagatcctgaagtgctgttatcggaaaccatcagacatttccgtctgtactctcagaaagcaccgaatgacccacagcaagctgatattttaggtgctctaaagcacctaagaaaagaactgcaaagtctgagaaataggaaaaatgtctgagacagcaaaatatgaaaaacctgctcatcgttcagcttccaaaattctgaagtctggaagtttttccttcaagaaaagaaactgcataaaaaatttaaaactaagtcatctcccagatataagtatcatggtccagcagtactgtttaatggggtattcagtgactaaggtctgctatttatgcaaaattctgtttatcccgtgttaccaaattaccatttcagtgagaagcttttgaaaagtcttctgacttccagtctttcaccagatgactgcactggattagattctagaagagaatgaaccattttcatataactaaatattggtcatgaactgtgtaagggccatgctt

SEQ ID NO: 194134 - DNA, 766 bp, Homo sapiens
  Payload ID: 18350
  Gene Name: transmembrane protein 260
  ENST ID: ENST00000555905
  CDS Start-End: 1-304
gtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaagtggaacgattctggatgcagagcaatgcagtagtggccgtcctcgctggcattggtttggctgcagttgtgtctgagactaaccgagtgctgaatagcaatgggcttcagtgtctggaatggctttctgcaactctttttgtagtttaccaaatatattctaattacagatgatgacttacgagtggtatttacccaagatggcaaagcacttgccaggtgtcaactttcctgggaaccggtggaatcctgtggaaggaatattacctagtggaatggtcacatttaatctttatcattttcttgaagtaaataaacaaaaagaaacatttgtttgcataggaattcatgaaggcgacccaacctggaaaaagaactattcactttggccatgggggtcttgtgacaaattagttcctttggagattgtattcaaccctgaggaatggattaaacttacaaaaagtatctataactggaccgaagaatatggaag

SEQ ID NO: 194135 - DNA, 547 bp, Homo sapiens
  Payload ID: 18350
  Gene Name: transmembrane protein 260
  ENST ID: ENST00000556929
  CDS Start-End: 1-62
ttctctgtggcttatttggagcagtagctgcatcattactttttttcaccgttttcaggtagctaaaattggtgctttctgctgtggccttagtttatgtaaccagcacacaataatactctatgttttgtgcataataccttggattctctttcaacttttaaaaaagaaggaactctccctgggctctttgttgaagttgagcctgtacttctctgctggtttgctgccctatgtccaccttcccatctcatcttaccttaatcacgcccggtggacctggggagaccagacaacactgcaaggatttttgacacattttctcagggaagaatatggaaccttcagcctggccaaatctgaaataggatccagtatgtctgaaatactgctttctcaagtaacaaatatgaggaccgaactctcattcaacatccaagcccttgcagtttgtgcaaatatatgtttagcaacaaagtggaacgattctggatgcagagcaatgcagtagtggccgtcctcgctggcattggtttggctgcagttg

SEQ ID NO: 194136 - DNA, 2755 bp, Homo sapiens
  Payload ID: 18351
  Gene Name: transmembrane protein 261
  Uniprot ID: Q96GE9
  ENST ID: ENST00000358227
  CDS Start-End: 334-672
taaggagactgaaaggtgattcatttagtgagtagcgattacagaatttctaaaacagtgggggcggggggggcggcggggaggagggctggaattgtcctccagcgcatacaaggttgttgctgccagagaaatccagcaggaaagagcagcattctttcaccttttccgcctctgaagcggaggagaacttcatttcccagcagcccttaagattcctccgcgcactgcgctagcgtcccggcattctgctttccggcgctctgccttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctccccagcagaacaccgcctgttgaagacctgctggagctgtcgcgtgctttctgggttggggctgatgggggcgggcgggtacgtgtactgggtggcacggaagcccatgaagatgggataccccccgagtccatggaccattacgcagatggtcatcggcctcagcattgccacctggggtatcgttgtcatggcagaccccaaagggaaggcctaccgcgttgtttgaaagtaccaccagtgaatctgtcttctgtctctgtccctttccccgtgacacacacagcaggcatggaatttaatgggtgttctggacagacacttgtacatggacagacatcactactgtggatactacaagactgagaagaaaatcgtatgttgtcattctctggctatggagtgtttgtggccttcacagatttcacaggaaccaataaatccctcagagaagtaaacaggttctttgtcttatctggggaaggaaagtataacttatatttaaatataattgcttaattaagcattatatataaacataatagtatgtcttatataattgcatgtcatattatatataataaacataaatatgtttagttatatagttagtataatttttaaaacttttaaatacagcatatggtaaaccaacgggaaaattagctattttacttcattattttaaagagttctttttatttctttcataattggatcaacaactgttaacctaaccctgggtgggcatcatgcaatatatagaagtacgtgaaattttctgtgtatgaattgctgatactttgcaaggcattttcaaatccatcaccttatgagagcttcacagctagtctgaggtagttacttcattggaggtaaaacttaaaacacaagaaagagcccacatgatttgcctagggtcattcagtaagtccgtgatggagctagaacttgttcttgtcagttttttgttctagtcttccctttcatggaggcaagaataaccattatgaaacagttagataatcataaaaatcagcatacaataaaagacttaaatgtcacaagaaaaattcaaaacctttagctaaaaaaaaaaaagatcttttgattctttttccacaagcactagatatgtttctgtgatgattttgagataagtactcaaaattacatagttcatttctaagagaaggccatgttttctacctattgggtttttctaccctgagatactatggcttctttgtaaaggtatataaagtgtttttcaaagcggaaagatactgttaaattcagctgctaatcatagtgtatttgtttggaatgacatgttgagcaggtagtacctttacggctgttgctttttgcagcattatgtggaagtgcctaagtctatttagcctcacagatgactttagaatcttgtattttctacatcagagttcatagcggggatggtgctacatatatctatgcaactgaaaaagaaaacatttcaaacctaaagtacgcaacaagatattatttatatgaaatccatagctcagttatgctatgttcatgaatagagaagttttaagttggaagggaccatggatgacccaaagcagatacatatggtcattcatatacctaaaatacctacaaagacaagttgttccctggtttaaaaggcagtctgttctattgatggactgctttagtccctgaacattttctttggttaaaccaaaaacacataaacctaacttggtcttggcttgatctactgggtaaataataactcttaaatatatatacagttgacccttggacaacacaggagttaagagcgctgaacatttgctcagtggagaatctgcatataacctgactcctcaaaaacttaattagtagttagtttacaattgactggaagccttattgataacataaagcagttgattaacacattttttgtgttgtatgtattatattccgtattcttacaagaaggtaagctagagaaaaaaaaaatgttattaaggaagtaatatattcactattcgttaggtagaagtgaatcatcctaaaggtcttcatcctcatcttcacgctgagtagtctgaggagcaagaggagttggtctttctgtcccagtggcagaggtggaagaaaatccacagatacgtggacctgcgcagttcaaacctgtgttgtttgggtcaactgtattgtaatagcattttaatgtttttctcagacttttacgagtatgaatctgagctttttctgaataaacctgcctgctcaccattaataatgccaaa

SEQ ID NO: 194137 - DNA, 494 bp, Homo sapiens
  Payload ID: 18352
  Gene Name: transmembrane protein 262
  Uniprot ID: E9PQX1
  ENST ID: ENST00000530719
  CDS Start-End: 61-411
ctgggcagggcctgcttgctccagctctcaagtctgacttgcatctacactgcgggcaagatgtggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaagtacgtctgcttctccgccctgaccatcctgatgctcaacggagccatgttcttcaaccgcctgtccttggagtttctggccatcgagtaccgggaggagcaccactgaggcctggggagtcggaacagggctaaggagggggaagcaaaaggctgcctcgggtgttttaataaagttgttgtttatttcca

SEQ ID NO: 194138 - DNA, 436 bp, Homo sapiens
  Payload ID: 18352
  Gene Name: transmembrane protein 262
  ENST ID: ENST00000524603
  CDS Start-End: 118-436
tctgtagactgtgttcacactgcctccgttttgggaaacttgagacatgcataaaagcgtctagaggcctgcttgctccagctctcaagtctgacttgcatctacactgcgggcaagatgtggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaagtacgtctgcttctccgccctgaccatcctgatgctcaacggagccatgttcttcaaccgcctgtccttggagtttc

SEQ ID NO: 194139 - DNA, 396 bp, Homo sapiens
  Payload ID: 18352
  Gene Name: transmembrane protein 262
  ENST ID: ENST00000524632
  CDS Start-End: 1-339
ctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaatgctcaacggagccatgttcttcaaccgcctgtccttggagtttctggccatcgagtaccgggaggagcaccactgaggcctggggagtcggaacagggctaaggagggggaagcaaaaggctgcctcgggtgttttaataaagttgttgtttatttcca

SEQ ID NO: 194140 - DNA, 391 bp, Homo sapiens
  Payload ID: 18352
  Gene Name: transmembrane protein 262
  ENST ID: ENST00000525544
  CDS Start-End: 61-391
ctgggcagggcctgcttgctccagctctcaagtctgacttgcatctacactgcgggcaagatgtggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgtgctcaacggagccatgttcttcaaccgcctgtccttggagtttctggccatcgagtaccgggaggagcaccactgaggcctggggagtcggaacagggctaaggagggggaagcaaaaggctgcctcgggtgttttaataaagttgttgtttattt

SEQ ID NO: 194141 - DNA, 3362 bp, Homo sapiens
  Payload ID: 18353
  Gene Name: transmembrane protein 263
  Uniprot ID: Q8WUH6
  ENST ID: ENST00000280756
  CDS Start-End: 419-769
ggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaa

SEQ ID NO: 194142 - DNA, 811 bp, Homo sapiens
  Payload ID: 18353
  Gene Name: transmembrane protein 263
  Uniprot ID: Q8WUH6
  ENST ID: ENST00000547242
  CDS Start-End: 411-761
ctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggctggagtgcagtggcttgatctccactcactgcaacatccgtctcccaggttcaagagattttcctgcctcagcctccctggtagctgggattacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattg

SEQ ID NO: 194143 - DNA, 925 bp, Homo sapiens
  Payload ID: 18353
  Gene Name: transmembrane protein 263
  Uniprot ID: Q8WUH6
  ENST ID: ENST00000550344
  CDS Start-End: 390-740
acgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacagtcttgctctgtcgcccaggctggagtgcagtggcttgatctccactcactgcaacatccgtctcccaggttcaagagattttcctgcctcagcctccctggtagctgggattacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttc

SEQ ID NO: 194144 - DNA, 833 bp, Homo sapiens
  Payload ID: 18353
  Gene Name: transmembrane protein 263
  Uniprot ID: Q8WUH6
  ENST ID: ENST00000547081
  CDS Start-End: 372-722
agtgctgggtgtacaacgtggagcggagggaggaggtgccaagctcagtgctagccacggcgcctccagggtcattttctgcctcctgccacgtcactcactgctaaagaaaaaaaaaagatttgctagtgcctaaagggatcagtagggagagaaggggccacccggaagggtttagaaacacctagagaaaagggaagggttcttaatttgatttttgcgtccttgtgaacactgtgctaattccaaatgaaaatatttgctatatgtgattatttgctgtatgctattgtttagcctttgaaacttctgctggtgtgagtgccctcaggggttccccaggaatatcgatacaacaccaacaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgc

SEQ ID NO: 194145 - DNA, 3349 bp, Homo sapiens
  Payload ID: 18353
  Gene Name: transmembrane protein 263
  Uniprot ID: Q8WUH6
  ENST ID: ENST00000548125
  CDS Start-End: 354-704
gccggaccctgcgagaacgggtgggcgtgtgcccggtgggcgcgggaggggcccgggctgcacgagcgcgcgtgcgcgtcggaactggagccgcgggaggaggcgggagctgaggaggcggcggagggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagg

SEQ ID NO: 194146 - DNA, 621 bp, Homo sapiens
  Payload ID: 18353
  Gene Name: transmembrane protein 263
  ENST ID: ENST00000551489
  CDS Start-End: 297-467
gggggcgggtcgcgtcgggcgccacgtccgcagccagaggcctccgcctccaccaccgccgccacagtcttccagctccacatcctgagaggacgcctctggagccgcgactgcccggggttgtgccggccgccgctgccgcccaggccgcctcagctctcctctgcgccggcccgctcactccgcccggccccagccctagcgctggccgcgaccccggcgcctttgaaacttctgctggtgtgagtgccctcaggggttccccaggaatatcgatacaacaccaacaggagatcatgaatcagacagataaaaatcaacaagaaatcccatcataccttaatgatgaaccaccagaagagtcttactctgtcaacccaggctggagtgcaatggcacgatcttggcccactgcaacctccgcttcctgggttcaagcagttctcctgcctcagcctcccaagtagctgggattacaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaa

SEQ ID NO: 194147 - DNA, 1483 bp, Homo sapiens
  Payload ID: 18353
  Gene Name: transmembrane protein 263
  Uniprot ID: Q8WUH6
  ENST ID: ENST00000551813
  CDS Start-End: 183-533
tttattaaatgccgcagtttgaagtaggagagaaacaagatgaagactagttgtatagtgggtacaaaatgttgtttatctgaataatgttgatgaaatcgcaatttagcatgtgataagaggtagtctcacatgttgaggttaaaatgaaatgtgtttgtatgttttttttttaggagatcatgaatcagacagataaaaatcaacaagaaatcccatcataccttaatgatgaaccaccagaaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacacccc

SEQ ID NO: 194148 - DNA, 995 bp, Homo sapiens
  Payload ID: 18354
  Gene Name: transmembrane protein 265
  Uniprot ID: A0A087WTH1
  ENST ID: ENST00000615541
  CDS Start-End: 331-657
agacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaaggatcctggttggaaggatggggactctctcaaggggctttggaagagctcttctagccctttataaaaggagggcagcagctgagactgatgagaggagggcagcctgctctgttctttcagggccccccacccccatctcccctaccctagcccaccctagggcctctacccagcgggaggggttgaagaccaggcctggttttattagaattcattttgtaataaaagccttttttagtggtgaaa

SEQ ID NO: 194149 - DNA, 2520 bp, Homo sapiens
  Payload ID: 18355
  Gene Name: transmembrane protein 266
  Uniprot ID: Q2M3C6
  ENST ID: ENST00000388942
  CDS Start-End: 277-1872
cgcgggctcggccaagccgccggcgcgaggcctcgcgcgcgcccccgagcgcggtgggcggaggggcggagggagcggcggggccgcgagggggcgggggggcggagaggggagccccgggagcgcgagccgcggccggcgccgctgcagagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaagggtctaactggctgaagccgtgctgtgggaagagagcagccgtgtggcaggtatttttgctcagtgcaagtctcaacagtttcctggtagcctgtgtaatattggtggtgattctcctgactctggaacttctaatagatataaagcttctccagttttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgaga

SEQ ID NO: 194150 - DNA, 2292 bp, Homo sapiens
  Payload ID: 18355
  Gene Name: transmembrane protein 266
  ENST ID: ENST00000484722
  CDS Start-End: 156-461
agcgcgagccgcggccggcgccgctgcagagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaagggtctaactggctgaagccgtgctgtgggaagagagcagccgtgtggcagtttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacagggtaagtctgttcaaccagaagaaccaggagggcttcactgtctttcagatcaggcctgtcatccacttccagcccactgtgcccatgctggaggacaagttcagatctttggaatccaaagagcaaaagctgcacagggtccctgaggcctagagcctgccatgggctgggtgagatgaggggagacagccatctcaaagctctcctgggaccctggaggctgccaagggccacacgcggggcccaggagcccacctggcctccctcagggtgctgcctgcctccagggaggcgacgccaggccaggaggccacaagcttcagacctcaaagcccagagctggcgcctcttctcgccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgag

SEQ ID NO: 194151 - DNA, 1762 bp, Homo sapiens
  Payload ID: 18355
  Gene Name: transmembrane protein 266
  ENST ID: ENST00000561302
  CDS Start-End: 129-494
agagccgagcgaatcccgagcccgggcagcagggcactatatttgtatgtgtcttgtagaacccacgcttggaaatgctgacagcaggcttcaggacagctgagccccactaaacaccaagaaaacccatggctgtggctccatctttcaacatgaccaatccacagcctgccatagaaggaggaatttctgaagttgagatcatctcccaacaagtagacgaagaaaccaagagcattgctcctgtgcagctggtgaactttgcctatcgggacttgcccctggctgctgtcgatctctccacggcgggctcgcagctcctgtcaaatctggacgaagattaccaaagagaaggtttccagcgcattccagtttgctggcgtgattcactggatcagcctggtcattctgtccgtgttcttctcagagactgttctacggattgtggtgcttgggatctgggattacatcgaaaacaaaatagaggtgtttgacggggctgtgatcatcctatctttggctccgatggtggcatccactgtggccaatggacccaggagcccctgggacgccatcagcctcatcatcatgctccggatctggagggtgaagagggtcattgatgcctacgtcctgccagtgaagctggagatggagatggttatccagcagtacgagaaggccaaggtcatccaagacgagcagctggagaggctgacgcagatctgtcaggagcaagggtttgagatccggcagctgcgcgcgcacctggcgcagcaggacctggacctggctgccgagcgcgaagcggcgctccaggccccgcacgtgctcagccagccgcgcagccgcttcaaagtgttggaggccggcacgtgggacgaggagacggcggccgagagcgtcgtggaggagctgcagccctcgcaagaagccacgatgaaggacgacatgaacagctacatcagtcagtattacaatgggcccagcagtgacagcggtgtcccagagccagctgtgtgtatggtcaccacggccgcaatagacattcaccagcccaacatctcctcggacctcttctctctggacatgcccctcaaactcggcggtaatggcaccagcgccacctcggagagtgcctcccgcagctcagtcacccgggcccagagtgacagcagccagacgctgggctcctccatggactgcagcactgcccgcgaggagccgtcctctgagcccggcccttctcccccgccgctgccatcccagcagcaggtggaggaggccacagtccaggacctgctgtcctccctgtcggaggacccctgcccttcccagaaggccttggacccagcccccctcgcccggcccagcccagcgggctcggcccaaaccagccccgagctggaacacaggatggagtctcgttctgtcaccctggctggactgcagtggcgcgatctcggctcactgcagcctccgcctcctggattcacgccattcttctgcctcagcctcccaagtagctgggaccacaggcgcccgccaccatgcccagctaattttttgtatttttagtagagatggggtttcatcgtgttagccaggatggtctcgatctcctgacctcaggtgatctgcccgcctcggcctcccaaagtgctgggattgcacgtggcctcaaccatattactgtgtattagttcagaaagtgctttcattagattcatttgatttaacaatcaaatcttgaattccttca

SEQ ID NO: 194152 - DNA, 1578 bp, Homo sapiens
  Payload ID: 18356
  Gene Name: transmembrane protein 27
  Uniprot ID: Q9HBJ8
  ENST ID: ENST00000380342
  CDS Start-End: 257-925
cttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcacagaatggctaaggcagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctctttttgattgtg

SEQ ID NO: 194153 - DNA, 4594 bp, Homo sapiens
  Payload ID: 18357
  Gene Name: transmembrane protein 30A
  Uniprot ID: Q9NV96
  ENST ID: ENST00000230461
  CDS Start-End: 331-1416
cccgtcacaggacagatgatcagggtgcgtccgccttttcgttcccgcttctatcctcctcccctttcccctccccatgtccctccttcttctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaattttgctatgttcaggtgtcttgataaaataacaatgctccagtgttgttgcttacatttagcactaaattttaacacagcgtcagtgagtccaggttttaacttcttcatgcctggatgggataaaatgtaattcattgttaaattaattcatatttgtatttattaatcactgtgacaacattaaccatttgttcttaccaggaagtggtcagattatcatctgagttacagttagactggctaagtttggtattagatcaaggggaatgtccagtaaacagagaggtaagcatgatggaaataatgaagtggggtacacaggaaaaacctgactagtgaggaggagcagctgagagatagggtcagtgaatgcggttcagcctgctacctctcctgtcttcatagaaccattgccttagaattattgtatgacacattttttgttggttaagctgtaaggttttgttctttgtgaacatgggtattttgaggggagggtggagggagtagggaagtggtccttttacaagaattttgatgcataagtgtctattgtagggtttggatgatctagtaaagtgttttagaacccctttttatcccatgcaccattcagtaaacataaaaatcacaattctgctaatgtcatttggaacttcaaaataaatatcttgtctaaaaacaaa

SEQ ID NO: 194154 - DNA, 3775 bp, Homo sapiens
  Payload ID: 18357
  Gene Name: transmembrane protein 30A
  Uniprot ID: Q9NV96
  ENST ID: ENST00000370050
  CDS Start-End: 558-1286
acactggctaccatgggtttatggagaggaagaacccatctctccctttggtttctgaagtgggaggtggagccctgcatccttccaaaactcacaatggacagttccacaaaacttggaaacaattccagcaattgccagggtaattgtatttttaaaatgagatgatgtgtgttagataatcagtgccatgaagaaaagtcagcatagagacagaggacctctcagaaacgcagtctttactttctgcagaaagggcgctccttgaagatggaacaatggtgagagcacacttgaacaaaggaaaagcaacatatttatcccttatgcatttggatcatccttactgtcgtatcctgcatccattggctggagctggacctcacagttttaaactgatacccgatttgctaataacctaaaactttcctaaatagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttcggagtatttggtgtgttctttgtctaaaaatagtctgttttgtcagtccttcagaatattatttattctgaagattgtccctcttgcacttggcagtttattttcggggatacattgttgggggagaggggtttctgccactctttccagattgagtctgtgctgtttaaggaggactaccatcctgcaactctttttctaactggggcacagaggatgtcgctaaagaaaagttgaagagccctttcagcactttctcatctgtggagaagatggaatcttaaaatacatttggagttttatctgttttacaagtccattgatggcctaagttcctcctgttttctgctgtttgatctctaaggaactcctgttgctaaatatgaagagtatggaacattcgtatagtctctgtgaagcatggggggagggaagacatttctttttcttataggctttatgctcaaatgtcatagtctcctttcaaagaattgtgttgcattttaaatgcacccagcttaagtagaagacattgaaggatgcattaattttcaggaactattttgaattatgaaaagattcccaattgaaaaaattattcaacaagtaaaagctaagaaatttcattgaaatcataaggcagtttaagcataaattgataaaaatagctgtgtactactaattaatagaaaatcattcaaccaagagaagagtcaagtgaatatcgtttgtttatttgctagtgagtttctttgtaacgttgattttattaaatgataatatttggttagtatgtcctatgttaataaaaatgaacaaaattaa

SEQ ID NO: 194155 - DNA, 445 bp, Homo sapiens
  Payload ID: 18357
  Gene Name: transmembrane protein 30A
  ENST ID: ENST00000518161
  CDS Start-End: 213-445
agttgactggctgacctcgcgccgtccaccacccccttccctctgtttctctgttttttctttctctttctgcgggtttcctgaatttgcagattgattataccggaacagagccttccagtccctgtaataaatgtttatctccggatgtgacaccttgcttttgtaccattaacttcacactggaaaagtcatttgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctat

SEQ ID NO: 194156 - DNA, 2791 bp, Homo sapiens
  Payload ID: 18357
  Gene Name: transmembrane protein 30A
  Uniprot ID: Q9NV96
  ENST ID: ENST00000475111
  CDS Start-End: 311-1288
cagggtgcgtccgccttttcgttcccgcttctatcctcctcccctttcccctccccatgtccctccttcttctccctcctccctctctccctccctctggcgtctccagccgactttcgcttcccgtcagcagcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgatggcgatgaactataacgcgaaggatgaagtggacggtgggcccccgtgtgctccggggggcaccgcgaagactcggagaccggataacacggccttcaaacagcaacggctgccagcttggcagcccatccttacggctggcacggtgctacctattttcttcatcatcggtctcatcttcattcccatcggcattggcatttttgtcacctccaacaacatccgcgagatcgagggcaacgtgtttatgtattatggactgtctaatttctatcaaaaccatcgtcgttacgtgaaatctcgagatgatagtcaactaaatggagattctagtgctttgcttaatcccagtaaggaatgtgaaccttatcgaagaaatgaagacaaaccaattgctccttgtggagctattgccaacagcatgtttaatgatacattagaattgtttctcattggcaatgattcttatcctatacctatcgctttgaaaaagaaaggtattgcttggtggacagataaaaatgtgaaattcagaaatccccctggaggagacaacctggaagaacgatttaaaggtacaacaaagcctgtgaactggcttaaaccagtttacatgctggattctgacccagataataatggattcataaatgaggattttattgtttggatgcgtactgcagcattacctacttttcgcaagttgtatcgtcttatagaaaggaaaagtgatttacatccaacattaccagctggccgatactctttgaatgtcacatacaattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaa

SEQ ID NO: 194157 - DNA, 4471 bp, Homo sapiens
  Payload ID: 18358
  Gene Name: transmembrane protein 30B
  Uniprot ID: Q3MIR4
  ENST ID: ENST00000555868
  CDS Start-End: 694-1749
aaacagatttatcataacgtaattccctggacactcccaacttgagactgaaagctgggcgaaagcggtttgtgaagctaacctaaaagacaaaatggtctagagccaccttttccccgcaaataacagaggattaaggatctgaaatcttcaagcctccaggaccacggtgcaagccctcagcaaaaatttctgctggaggccggagcgccttttgatttcgggagactggcccaggaactctagtcacttggaaggcggaagagaaggtggtacctgagccaggtaggagccactcagaggcagcccggggccgccactcacctaggagaggaggtggagtccgatgacctggactgagaggaaacgcgagactgagtctaccaggtgaggtaaaaaacacccacctgctcacctcggaaggggcgggcgaggtgcggctcccggtgacccgcgggggtgcagcgcacctgggcggaggcggaactgggagggtgtgggcactgctcgtagggcctggaactaaactcacctgtgacggaggcagaggaggggcccgggcaaaaacccacctgagctggcgggaaacccgacccgcgagcagtccccgggcttgcgcggcgcggagagggaggcgccccgcggcggggcccccactcggtcagcccgcgcgtcggtccccgcgcggccgccatgacctggagcgccacggcccggggcgcccaccagcccgacaacaccgccttcactcagcagcgcctccccgcctggcagccgctgctgtcggccagcatcgcgctgccgctcttcttctgcgcgggcctggccttcatcggcctgggcctgggcctctactactcctccaacggcatcaaggagctggagtacgactatacaggcgacccgggcaccggtaactgctcggtgtgcgccgcggctggccagggccgggcgctgccgcccccctgctcgtgcgcctggtacttctcgctgcccgagctcttccagggcccagtgtacctctactacgagctgaccaacttctaccagaacaaccggcgctacggcgtgtcccgcgacgacgcgcagctgagcggactccccagcgcgctgcgccaccctgtcaacgagtgcgccccctaccagcgcagcgcggccggcctgcccatcgcgccctgcggcgccatcgccaacagcctcttcaacgactccttctcgctttggcaccagcgccagcccggcgggccctacgtcgaggtgccgctcgaccgctccggcatcgcctggtggaccgactaccacgtcaagttccgcaacccgccgctggtcaacggcagcctggcgttggccttccagggcacggcgcccccgcccaactggcgccggccagtctacgagctcagccccgaccccaacaacaccggcttcatcaatcaggacttcgtggtgtggatgcgcacggcggcgctgcccacgttccgcaaactgtacgcgcgcatccgccagggcaactactcggccgggctgccgcggggcgcctaccgcgtcaacatcacctacaactacccggtgcgcgcgttcggcggccacaagctcctcatcttcagcagcatctcgtggatgggtggcaagaaccccttcctgggcatcgcctacctggtcgtcggctccctctgcatcctcaccggctttgtcatgctggtcgtctacattcgctaccaggaccaggacgacgacgacgaggagtgattccggctttccagggatccctcctgcttcttgccaaaactcttgcaaggtgcttttggcatctcctcctcgcccgtcacccaattccaacctcgcctagcttttcctccctttgtgaatgaggggaccagataagggaattaccccccttgctcttggggggctgctagactgtcttgccgcggggagggatgttgactgcagagtgaaacatccttgcaaactcttcccacctccttcacgacactgagttgccatgtgaggttcttcaagtctgagagtggaagggatccctatggagactcctattaaacccctattagaggaagagattgagagacctagcaatgtgaagtaacaaagatcaggcagctgcaagtgactcctgaatcttgagtccagggctttcgccactacagtacagtggttttcttttctttggtcggggagagtgggctggaatggagagtgaggcccacaaattacctgcagagacgtggaggcgtgagggagaacatgcttgttaaatatgcaggtagattaggagacaccaaacagagattcagacacagtaaggctgggatgagatcctcgaagctgtgttttaacaaactccactggagagtcccatattccctcaaatttgggaatcacgaccctgaaccaggttgggcctgaagcagtcaactgaattcactttttcggatagtaatttgttcccaggggcagtgacaaccatgatgttccaggtttggtctggcactctgccttgaacgtaggaagctcttgatgatttgtggaatgaatttttaaaaaattactatctggggaaaactagttggcatacagagttgtaggacagggtttatgtgattcatttgatattttagtattttggtgtaaaagccaacaggcaaactttgccaggtactgtgtagaaactcgaaaatgtgaggccagtttgtacagttcagaggaaatgctttaacgtagaatcagatagctggaagagatcttcgagggaaagtaagttccctaaagtcacatctatgtctcctagctcagtgttctttgtcattgtgtgtgtgtgtgtgtgtgtgtgtgtgtgtgtgtgtgattagaaagggcttcattcataccttttcccttggacctggaaaaaaaattttttttatcttttcaaatgaaatctattgatttctagtaatcatatttgaatcaatgttaaagcatatatagtcttatatgtaaactagattcttaagattatttgaacctttgagatgaagtttacactcaactaaaatcattccattgattttattgattaacatcaatcagtatgtttaaagttattctaagaagcaatagtttatttttaaaaaccttgtatagcaaaataacttaaaaccctttgtgatatcatcttaccagtttatttggtaaaaacaaacagttatttggtatttgtcagaattcttcagtgcctgctattacagctattttccaattactaacttgattatactcactcaaggcagtgcaagatcttgaagtactttttagcagttaagtaatattgaattgtattgaatagtttacatagtttattctagtctttgaaaattactgaacatggacaatgtgcatgtcattgacatctgccttagaacttctgggacaatcctgattcgagagattctatcccattatttacatataccaaaaatactttgttaatttaatgtgttggcttcccaactcctgaacacgacacaattttattattagattttgtatggtgattttaggctatgaaaacatgatcattatatgtatatagatacatttttatttgttacaaatgtttgagcagctcactagcccacccctcctctattttgggtaagagaatttactaccttttttaactatgtagttgagagcaacatgtattttgttatttttagaatggtcagtatattgctataaaattttaaatgagactatgaaagttaaagtattctgattctggttaaattaacgaatatggttccaggccctgttctctgggtttttgagagagaataaaggttatgtttgtcttacctttgttatcgagtttgctgaattcttttgaacgatgatcttaaaggcacaaacaccaccagccactttgctaatttcttaatagcagatttacattgcagcaagaaaaccatcttttatagtaacattcagttaaaatgaactcaattcattgttaacttcctaaaacagaatttgaactttatcaacctcaacgtgtatataaactagatagtcctcaatactttatcaacctcaacatgtatataaactagatagtcctcaaatactgtttgaatttaataaatgtcaatttaaaaatttttgtagtagtcttctgcattttacttcaattataaattgcaattatttattggatattttggacttcaaagcagcagaaactttaaaactgaaatgggaaacgttttcctgcaatgatccctgtgctgtaacattttgtctggtgtctcaggcttccaggttcttgttggcctgaattcccttgttgcccagtaaatgttcactagctagaagtatcttcaggaagtgagatagaaaagagtgaacctcaacaattggactggaaatgagctttgacctaactttgtaaaataaaagcataaaagagaaa

SEQ ID NO: 194158 - DNA, 454 bp, Homo sapiens
  Payload ID: 18359
  Gene Name: transmembrane protein 30C
  ENST ID: ENST00000476804
  CDS Start-End: 1-205
cctttgtatgggcatcatccttatattgtctgcaaggagcactcaggaaatagagattaattacacaagaatatgtgcaaattgtgcaaaactgcgagaaaatgcctctaattttgacaaggaatgcacctgctctattcccttttacctttcaggaaaaatgatggtaggtgaaattcaagaaactcggttgactttacactgatctattcctatgtaacacttagcagtaagttcacaatttccatgaaatgctttccaaaactgaaaatatgaaacataaagcaggatggtggtggtgaatccgaaagattgttgagttcatatcccctccctcctttttgagtattattctcctcctttgtttctaagttgcaagattctttacctatccaactttgtaacataaatcttatctaccaaacaggttttactctaaatatcagcacaggga

SEQ ID NO: 194159 - DNA, 728 bp, Homo sapiens
  Payload ID: 18360
  Gene Name: transmembrane protein 31
  Uniprot ID: Q5JXX7
  ENST ID: ENST00000319560
  CDS Start-End: 192-698
aggcagttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgcccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagca

SEQ ID NO: 194160 - DNA, 1570 bp, Homo sapiens
  Payload ID: 18361
  Gene Name: transmembrane protein 33
  ENST ID: ENST00000264452
  CDS Start-End: 357-563
aaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttggtgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggat

SEQ ID NO: 194161 - DNA, 677 bp, Homo sapiens
  Payload ID: 18361
  Gene Name: transmembrane protein 33
  ENST ID: ENST00000513558
  CDS Start-End: 1-467
ctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcgtttgtggtgccccaaaacagttacaatagtaacaccaaagagatcaccgtaacagaacagatcacagatcaccataatagattaataatgaaaacatttgaaatagtggaagaattggcaaagtgtgacgcagagacatgaagtgagcacatgctgttggaaagtggcactgatagtcttgctgtatgcggtgttgcaacaaaccttcaatttgtaaaaaatgaaatatctatggagtacaataaaatgaggtaagcctgtg

SEQ ID NO: 194162 - DNA, 7482 bp, Homo sapiens
  Payload ID: 18361
  Gene Name: transmembrane protein 33
  Uniprot ID: P57088
  ENST ID: ENST00000504986
  CDS Start-End: 366-1109
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaagatcttttagatttatagaagagtcagaaatgtacaagagagtttttttgttgttgtttttgttttttgagacagagtctgtctctgtcgccaaggctggagtgcagtggcgcaatcctggctcactgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtataaaataacactctgtgctttaaattgaggttttatgtcattttagcagaattataatatttctgatatactcatgtttgacaagttgaaacagatttgtttcttaaaggaaggtttaatatacaaaaaaaggtaatcttaaacttacgaaaaagtaaattttacaatttgagcattactagatgtttagtttgcatgaactcatagttagaaattctgcaataggaatatctacaaccggctgatttggaatttgaaattatagtgttacatgtatacctatcaaattaaaattaaggaaatacaatagcaatatatagaatgaatgtagtaacagaaattaactctttactgcatcattgaacttattgttagttacaggtttaaaagaagttcatttaacatccagtgtgtctaattcttctggaagtggtgtagtaccattgttcttctggcatttttaaatattaaacctttttggatagatggaagccttatacaaaatctactttattttagcaaggattctctgtccttttgtatagttggtaccttactaatttaaactctaatatcaatctaaagagaaatttattatgcaatttgtatttaggtttttttttttttttttggaatgaagttcagaggtagatcctcctggaagaaagaaagcaagcgaactttttaaagaaaattagacttgaatatttaagaatgtcccttacagagaaaaggccaactataatactaagctaaaagttatgaaaaattaataggttcttttatagagctaagaatgatgaaaccatcaatacttccttcttcctaaaaatccagatcaaaacttcaggttaggtttctaagtttaggacatgaatattatttttttctggaaaagaagatgagtatatgtgtaataagacaagtagaactgagagatttagttttttttttttttaagttttagttcagaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaaaaaattaagcattttttgtttgtttgcttgtttgtttttgagacggagtttcactcttgttggccaggctggagtgcaatggcgccatctcagctcactgcaacctctgcctcccggattcaagcaattctccttcagccctccaagtagctggggttacaggtgcccgccaccatgcccagctagtttttgtatttttagtagagatgaggtttcaccatgttggccaggctggtcttgaactcctgacctcgtgatccccccacctcggccttccaaagtgctggattacaggcgtgagccactgtgcctggcttgcatttttaaaatactgaattattcaaaagaagtaccctgtcaatatgtgctttctaggaaaacagtaaaataggccacaatttggagtgacaccattcagatcaaggtctatccagttttttcttttcatgctaagtgcctacatcaccgaaacacactaatataaaattatcctttctccttcattttcagatgtgtaaaaaatggtacttaaagtgttttcatgatcattttgtaggtagactagatatagcccgttgaacctcttttaaaatttagacttttgatagtaatataaaagcatattgaaatttgtagatattatatgaggaatggcacctagatttgaaaattatgcttggcttgtagagacaactagtttctctcgctcttttttttttttttttttttttttttgagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctggaatttagcagatacaaaaa

SEQ ID NO: 194163 - DNA, 574 bp, Homo sapiens
  Payload ID: 18361
  Gene Name: transmembrane protein 33
  ENST ID: ENST00000506794
  CDS Start-End: 42-248
tcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttggtgtccagatgtcttgctttaaaaaagagaggtcctcagctctttccatcttaaccccagtgaactagatacaaatggaatttaaccaagaaacaacttatttaagcagtgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtc

SEQ ID NO: 194164 - DNA, 867 bp, Homo sapiens
  Payload ID: 18361
  Gene Name: transmembrane protein 33
  ENST ID: ENST00000508448
  CDS Start-End: 201-867
aaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctg

SEQ ID NO: 194165 - DNA, 1092 bp, Homo sapiens
  Payload ID: 18361
  Gene Name: transmembrane protein 33
  Uniprot ID: P57088
  ENST ID: ENST00000513702
  CDS Start-End: 153-896
aaaggagcacttccgggttcggcaataacctggagccggcggcgtaggttggctctttagggcttcaccccgaagctccaccttcgctcccgtctttctggaaacaccgctttgatctcggcggtgcgggacagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactg

SEQ ID NO: 194166 - DNA, 6221 bp, Homo sapiens
  Payload ID: 18361
  Gene Name: transmembrane protein 33
  Uniprot ID: P57088
  ENST ID: ENST00000325094
  CDS Start-End: 334-1077
aataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaagatcttttagatttatagaagagtcagaaatgtacaagagagtttttttgttgttgtttttgttttttgagacagagtctgtctctgtcgccaaggctggagtgcagtggcgcaatcctggctcactgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtataaaataacactctgtgctttaaattgaggttttatgtcattttagcagaattataatatttctgatatactcatgtttgacaagttgaaacagatttgtttcttaaaggaaggtttaatatacaaaaaaaggtaatcttaaacttacgaaaaagtaaattttacaatttgagcattactagatgtttagtttgcatgaactcatagttagaaattctgcaataggaatatctacaaccggctgatttggaatttgaaattatagtgttacatgtatacctatcaaattaaaattaaggaaatacaatagcaatatatagaatgaatgtagtaacagaaattaactctttactgcatcattgaacttattgttagttacaggtttaaaagaagttcatttaacatccagtgtgtctaattcttctggaagtggtgtagtaccattgttcttctggcatttttaaatattaaacctttttggatagatggaagccttatacaaaatctactttattttagcaaggattctctgtccttttgtatagttggtaccttactaatttaaactctaatatcaatctaaagagaaatttattatgcaatttgtatttaggtttttttttttttttttggaatgaagttcagaggtagatcctcctggaagaaagaaagcaagcgaactttttaaagaaaattagacttgaatatttaagaatgtcccttacagagaaaaggccaactataatactaagctaaaagttatgaaaaattaataggttcttttatagagctaagaatgatgaaaccatcaatacttccttcttcctaaaaatccagatcaaaacttcaggttaggtttctaagtttaggacatgaatattatttttttctggaaaagaagatgagtatatgtgtaataagacaagtagaactgagagatttagttttttttttttttaagttttagttcagaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaaaaaattaagcattttttgtttgtttgcttgtttgtttttgagacggagtttcactcttgttggccaggctggagtgcaatggcgccatctcagctcactgcaacctctgcctcccggattcaagcaattctccttcagccctccaagtagctggggttacaggtgcccgccaccatgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgta

SEQ ID NO: 194167 - DNA, 2195 bp, Homo sapiens
  Payload ID: 18362
  Gene Name: transmembrane protein 35
  Uniprot ID: Q53FP2
  ENST ID: ENST00000372930
  CDS Start-End: 284-787
tttgaagtttccgtctttcctttagggcttcatttaacttcgagactgtccttttggcctgtgagcacacgtagggcattaggacccagcgtttgttgtagtgagagtggttgaatctcgatctctcaatttttctctcgagctccctcctctccctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcgcgcgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggagg

SEQ ID NO: 194168 - DNA, 1688 bp, Homo sapiens
  Payload ID: 18363
  Gene Name: transmembrane protein 37
  Uniprot ID: Q8WXS4
  ENST ID: ENST00000306406
  CDS Start-End: 36-608
gcgatcgaggctgcagcgcggccgccgggcgcagcatgactgccgtcggcgtgcaggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagacgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggcccgggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctaggactttcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtgcctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccagaa

SEQ ID NO: 194169 - DNA, 794 bp, Homo sapiens
  Payload ID: 18363
  Gene Name: transmembrane protein 37
  ENST ID: ENST00000409826
  CDS Start-End: 27-635
gaaactggagaaggcagtgggtgcagatgacccgacctgactgttcttctgattttaattccaggcacttccctcttggccaggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagacgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaa

SEQ ID NO: 194170 - DNA, 522 bp, Homo sapiens
  Payload ID: 18363
  Gene Name: transmembrane protein 37
  ENST ID: ENST00000417645
  CDS Start-End: 323-522
gtgaaaggatacccccgcaacaggacaggtcttcctttcccatgtgggctctttatccagaacccagagctgcggagagtctggcttctgggacccttgactggggagaaagcaggtgggggccacggagggaaggccccagagcagagaggcaccaggctggctgagcctgggcagctgccctttgccttagctcagtggttctcaaagcctggcccccaggccagcagcaccaacatcacttgaggccactcagccagaaactctgcagtggggcctcgcaatctgttttaacaaaccttccaggtgactctggtgcagaatggtggcaagaactcaaacctggactaggcctgctgggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctgg

SEQ ID NO: 194171 - DNA, 2649 bp, Homo sapiens
  Payload ID: 18364
  Gene Name: transmembrane protein 38A
  Uniprot ID: Q9H6F2
  ENST ID: ENST00000187762
  CDS Start-End: 92-991
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccagcagacccgctggctcccagtgtccaaagccagcctcatcttcatcttcaccttgttcatggtgtcctgtaaggtgtttctgacagccacccactcacacagctccccctttgatgccctggagggctacatctgccccgtgctgtttggttcggcctgcgggggtgaccatcaccacgacaaccatggtgggtcccacagcggtggtgggccaggagctcagcattcggccatgcccgccaagtccaaggaggagttgagcgagggctccaggaagaagaaggccaagaaggcggattagggggtggcccaaggggcaccggggagaggacccggacccaggaccctctgagctgggaggcttcctgcgctcagatctatcctttcctggccttgacttccccatctgcaaatcagggtcattggctcaccctccagggctgatgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttgtatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctcaaaaaaaaaaaaaaaaattgcatattgactcctgaagaacttcaagccatgttgagatccattcatttgatggacattttctaagtacctgtgagccaggtgctgccatttcaaagtctcttcttaccacgctcctcagtggctagacattttcacgtggccagaaagtcccgactcttgctgggcgtccctggacaagttgccttcctcctctgagcttggcgctccccatctgtatagtggagacccttggcccccctctgtacggaagggccgatgcgaagctgcagttaaaaaaggctcacatgctcctagcctcgtgcagtcaggaggggagaccaggacagttggaaattatgattgcaaatggctttgcattttagatcattcgtgtgtgtggatcagagaaacgcacaagttccctggcacaaaggaagccctcagtagacacgtctagggcaggcttgagagatcagatggcgtgaaaggcttgtgatctgttcgtctcaggctccccctaaaccaaagaaatggaaacagctggttggggttccacgatccagctctatcaaggggctctgagtgtgcacagttgggacctggatgtatcaggtctccctcaggctggagtccactgtcactcattcagccattgaacaaacatacagatgcttacctgctctgtggtcagccttgtgctgctgctgggcgggccaggagcctgcttcagtgtgagcgaggtggatgatattatagctgaagggtccctcctggtcaccctcatctcagcctaggtcaccaggatgtctgagaggggtgggtgcatgggacgggcgtggccagtctcaggtgaggtttgggcccagacctcgttggagtcccagacgttgccaggctgttggaaaattgccttgttcctgtgatgcctgggagttaggtgggtcctggggaggtttcatcctcttgcttgtccacctcagctcggtgtggaggggcagccaataaatcattgtgaatgaaccctca

SEQ ID NO: 194172 - DNA, 410 bp, Homo sapiens
  Payload ID: 18364
  Gene Name: transmembrane protein 38A
  ENST ID: ENST00000599479
  CDS Start-End: 1-347
gcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggaggttgcagtgagctgagatcttcccactgcactccagcctggccaataagacctgtctccagcaagaccctgtctcaaa

SEQ ID NO: 194173 - DNA, 3956 bp, Homo sapiens
  Payload ID: 18365
  Gene Name: transmembrane protein 38B
  ENST ID: ENST00000374688
  CDS Start-End: 711-1424
gcagtgtttcctccacaggggtctcagtctgggctctaaagagctcctccaccaagtttctaaattttaataatttcagcctattgttcccccagagtagtaactgctttctggaactgaactctgtgataatgtagtatttactttttgccttttcaataacctagttaacaattttatacctactgagttctatttaaataatggtattttctatctcctgactggacagatacccaggagtagggtttgaacttcctactttctggtttgcatatatcttattaagataactaaagtacttgctacttgccagtcttcagacccggtcagtgtaatgtcatcagtgcagcagatcagtgtgatgtgtgatttctcaatgtgatcaaaatctctggactattttagagagcaagagtgttaacatagacctgaagcaagactgtaatggttgaacaaagcacaaagtgcttctgagattttttgcaaattaataggaagaaaaaagcatttgcttccaagttataagaattgtgttgatttgaccccgtaaaaatactacatcttgaatactagctgcaattacagtcacgacctttctgtgtttataattcatagctattctccaagatccatctgtcttatatttagatcaaacaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaatggagtattacattatttttatgttttatatttttcttgaggtagagtttcagaactcatctagtattttgactaatatagtatatattcagtgattactgttcaaatgggacattggtagaaactttattaatctatgcaagtatcctataaccctcaattcaaggctcttttgtaaaaaatgtactggagaacatggcttaggcctgaaacccatcctgaatctattcaggtcacctgtagagtcttgacttggatttgcaaagcagattgttagactccttacccaatgtgaagtgtgaataaggcctataggcctgcctcacacagctaatcagaggtggcactgagaaagtcaagtcctaataggtctccttaaaaaaaaaaaggagacaaaaagctggcaagaacatgagccagcttccctcagtgctgtcactctcaagtaaaacatggccaaatgaatatcaaactggtttatcagattagtcactcttccttactgagggagtatcaagtaagggctggagagagaccagatatgtggagttgttggctttcagtggaaatggtagcctccctgtgggtagagaccaaaaggtagagagatgacagaagggagactctgattagtgtattttttttttgtctattccttaaagcccagacacctttccattaaaatctacttcaaatcacaagttgattacaattgagtggaacatcccatgttgtaaatggaataatgtgttcagaatgctctttctttcccccaataaagccctttatagtgttt

SEQ ID NO: 194174 - DNA, 3525 bp, Homo sapiens
  Payload ID: 18365
  Gene Name: transmembrane protein 38B
  Uniprot ID: Q9NVV0
  ENST ID: ENST00000374692
  CDS Start-End: 118-993
gctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaatggagtattacattatttttatgttttatatttttcttgaggtagagtttcagaactcatctagtattttgactaatatagtatatattcagtgattactgttcaaatgggacattggtagaaactttattaatctatgcaagtatcctataaccctcaattcaaggctcttttgtaaaaaatgtactggagaacatggcttaggcctgaaacccatcctgaatctattcaggtcacctgtagagtcttgacttggatttgcaaagcagattgttagactccttacccaatgtgaagtgtgaataaggcctataggcctgcctcacacagctaatcagaggtggcactgagaaagtcaagtcctaataggtctccttaaaaaaaaaaaggagacaaaaagctggcaagaacatgagccagcttccctcagtgctgtcactctcaagtaaaacatggccaaatgaatatcaaactggtttatcagattagtcactcttccttactgagggagtatcaagtaagggctggagagagaccagatatgtggagttgttggctttcagtggaaatggtagcctccctgtgggtagagaccaaaaggtagagagatgacagaagggagactctgattagtgtattttttttttgtctattccttaaagcccagacacctttccattaaaatctacttcaaatcacaagttgattacaattgagtggaacatcccatgttgtaaatggaataatgtgttcagaatgctctttctttcccccaataaagccctttatagtgttt

SEQ ID NO: 194175 - DNA, 502 bp, Homo sapiens
  Payload ID: 18365
  Gene Name: transmembrane protein 38B
  ENST ID: ENST00000434214
  CDS Start-End: 396-502
gctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccggggtctcactgtgttgtctaggctgagtgcattggcactatcatggctcactgcagcctggaactcctgggctcagtgattcttccactttagcctcctgagtagctgagactacaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctg

SEQ ID NO: 194176 - DNA, 721 bp, Homo sapiens
  Payload ID: 18365
  Gene Name: transmembrane protein 38B
  ENST ID: ENST00000435034
  CDS Start-End: 1-488
tatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagtctctgaattggagatgatctgtggctgtaattcagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaata

SEQ ID NO: 194177 - DNA, 451 bp, Homo sapiens
  Payload ID: 18365
  Gene Name: transmembrane protein 38B
  ENST ID: ENST00000451560
  CDS Start-End: 1-244
ctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagtagtctctgaattggagatgatctgtggctgtaattcaggtaacaaatattggaggcaaaatctcttcacatgtagtctcttccagtcctcaaatgttgagccgtgtatatttttttctaacagctttattgagatatattttccatactgtgttagtctgttctcatgctgctaataaagacatacctgatactgggtaatttataaag

SEQ ID NO: 194178 - DNA, 4369 bp, Homo sapiens
  Payload ID: 18366
  Gene Name: transmembrane protein 39A
  Uniprot ID: Q9NV64
  ENST ID: ENST00000319172
  CDS Start-End: 422-1888
gcactcgcggctggggcagaccgcggtcgcgtagctgacgtcatcgccgtgcgctgccacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgaccttttttgtaa

SEQ ID NO: 194179 - DNA, 4393 bp, Homo sapiens
  Payload ID: 18366
  Gene Name: transmembrane protein 39A
  Uniprot ID: Q9NV64
  ENST ID: ENST00000438581
  CDS Start-End: 337-777
ggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggtctgtgtgtgtaagctctgattttcaggaaccctatttctggaagcagagtaactggaaatactaagtcaagatctgaaaaccatttgaagttaaccaaaaagcacaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgaccttttttgtaa

SEQ ID NO: 194180 - DNA, 868 bp, Homo sapiens
  Payload ID: 18366
  Gene Name: transmembrane protein 39A
  ENST ID: ENST00000490099
  CDS Start-End: 351-491
tccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacc

SEQ ID NO: 194181 - DNA, 935 bp, Homo sapiens
  Payload ID: 18366
  Gene Name: transmembrane protein 39A
  ENST ID: ENST00000468676
  CDS Start-End: 361-935
agaccgcggtcgcgtagctgacgtcatcgccgtgcgctgccacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcgtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctaccc

SEQ ID NO: 194182 - DNA, 588 bp, Homo sapiens
  Payload ID: 18366
  Gene Name: transmembrane protein 39A
  ENST ID: ENST00000461654
  CDS Start-End: 253-588
gacgtcatcgccgtgcgctgccacgtctgctcagctccgcggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactg

SEQ ID NO: 194183 - DNA, 590 bp, Homo sapiens
  Payload ID: 18366
  Gene Name: transmembrane protein 39A
  ENST ID: ENST00000497993
  CDS Start-End: 171-590
gtggggaggataaacgaatggaccagttgcctatcctccctccctggcacccctgggaaaataggtctgcagccagaaaactgaaggtcagagaggagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagag

SEQ ID NO: 194184 - DNA, 852 bp, Homo sapiens
  Payload ID: 18366
  Gene Name: transmembrane protein 39A
  ENST ID: ENST00000491685
  CDS Start-End: 356-852
tcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtga

SEQ ID NO: 194185 - DNA, 3043 bp, Homo sapiens
  Payload ID: 18366
  Gene Name: transmembrane protein 39A
  ENST ID: ENST00000473684
  CDS Start-End: 1-57
tcctacagcaatgctccacagcacatattagcacaggccttcaagcccaggaactgaaagagattgggccaggctgaaaagaaacccgactgtgggcaaaggacagatttcaataaaaattgaaaatacaatccacagtactagtactgtacatcttcaggctactgatggcacatggccatgaggtgtatcatcactttaatgctgttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgaccttttttgtaa

SEQ ID NO: 194186 - DNA, 1813 bp, Homo sapiens
  Payload ID: 18367
  Gene Name: transmembrane protein 39B
  Uniprot ID: Q9GZU3
  ENST ID: ENST00000336294
  CDS Start-End: 147-1625
gtatgcaaatgtagcggcgcggcgggagcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactccc

SEQ ID NO: 194187 - DNA, 1538 bp, Homo sapiens
  Payload ID: 18367
  Gene Name: transmembrane protein 39B
  ENST ID: ENST00000441402
  CDS Start-End: 106-687
cccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctggtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaa

SEQ ID NO: 194188 - DNA, 690 bp, Homo sapiens
  Payload ID: 18367
  Gene Name: transmembrane protein 39B
  ENST ID: ENST00000438825
  CDS Start-End: 114-690
ggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatgg

SEQ ID NO: 194189 - DNA, 984 bp, Homo sapiens
  Payload ID: 18368
  Gene Name: transmembrane protein 40
  Uniprot ID: Q8WWA1
  ENST ID: ENST00000264728
  CDS Start-End: 216-917
tttttaacttgtttaactaagggtggctcctgttgagaggtgacagcgtgttggcagccctcgcagccctcgcttgctcttggtgcctcctcagcctcggcgcccactctggccgcacttgaggagcccttcagcccgctgctgcactgtgggagtcccttcctgggatggccgaggccggagccggctccctcagccttccgggaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccaca

SEQ ID NO: 194190 - DNA, 2308 bp, Homo sapiens
  Payload ID: 18368
  Gene Name: transmembrane protein 40
  Uniprot ID: Q8WWA1
  ENST ID: ENST00000314124
  CDS Start-End: 358-1059
agagcttggtacagccaagggtggcacagctgcccccatttcactgtctcctggagtctgaaggcatggctgtggccctgaggcaggaccaggcatgtagctgccccacctgcccctccgcagtgttgtagggaagagtcaagtcagacaggaaggcctggggctgatagcaccagcaggaaggaatgccatcccagtgagcgagtggggcccagggacaacgtcacggtagtcccgccctccttgctgtcacaggtgcagcctgtcctctccttcccctgaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaaacatataaataaaacacagttttcacgatagaa

SEQ ID NO: 194191 - DNA, 431 bp, Homo sapiens
  Payload ID: 18368
  Gene Name: transmembrane protein 40
  ENST ID: ENST00000428020
  CDS Start-End: 1-294
ctccatccaggtcctgggcatggggagcctgacgttttgaaggatgagcttcaactctatggagatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 194192 - DNA, 1785 bp, Homo sapiens
  Payload ID: 18368
  Gene Name: transmembrane protein 40
  Uniprot ID: Q8WWA1
  ENST ID: ENST00000435575
  CDS Start-End: 96-569
ctgtcctctccttcccctgaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactgtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaa

SEQ ID NO: 194193 - DNA, 1547 bp, Homo sapiens
  Payload ID: 18368
  Gene Name: transmembrane protein 40
  Uniprot ID: Q8WWA1
  ENST ID: ENST00000435218
  CDS Start-End: 78-689
gaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaatt

SEQ ID NO: 194194 - DNA, 1060 bp, Homo sapiens
  Payload ID: 18369
  Gene Name: transmembrane protein 41A
  ENST ID: ENST00000296254
  CDS Start-End: 27-305
cccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaa

SEQ ID NO: 194195 - DNA, 541 bp, Homo sapiens
  Payload ID: 18369
  Gene Name: transmembrane protein 41A
  ENST ID: ENST00000382227
  CDS Start-End: 75-374
agtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgggtacctatgatggcgggcctgcatgagatgctggaagacgtgtagaactgagtgaaattttctttgtcctcagagaggtgatggctctattaaagtgtccagagagaactcatctcacaccaagggcataggagcagccacacttaagatcaactgtccttaaccacagcatcatgatacgctggattaccca

SEQ ID NO: 194196 - DNA, 2827 bp, Homo sapiens
  Payload ID: 18369
  Gene Name: transmembrane protein 41A
  Uniprot ID: Q96HV5
  ENST ID: ENST00000421852
  CDS Start-End: 97-891
agtgaacgtgctccgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaaggagaaacatgttttccacatcatcgcaagtgtgtgccctttgccccttttcaggatccttagagttgcctccctccctccaccccgacagttttgcaataatgtgccttatcagttgtgagtttacaggtgaagcaatttcccaaataaatggatgtaagtgttc

SEQ ID NO: 194197 - DNA, 1443 bp, Homo sapiens
  Payload ID: 18370
  Gene Name: transmembrane protein 41B
  Uniprot ID: Q5BJD5
  ENST ID: ENST00000299596
  CDS Start-End: 127-1002
tcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattgtattggagaaacctaaa

SEQ ID NO: 194198 - DNA, 3848 bp, Homo sapiens
  Payload ID: 18370
  Gene Name: transmembrane protein 41B
  Uniprot ID: Q5BJD5
  ENST ID: ENST00000524543
  CDS Start-End: 196-774
gggtttagcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttttaccagcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttttctgttttgagacggagtctagctctgccgcccaggctggagtgcagtggcgcgatctccactcactgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcgtgagccaccgcgcctggcccattttcttcctcttttgaggtaatggatttgtttggagatggcatgttagtagacgactgaatatggaaaggatatcaagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataattttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccgtgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgttattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattgtattggagaaacctaaa

SEQ ID NO: 194199 - DNA, 3968 bp, Homo sapiens
  Payload ID: 18370
  Gene Name: transmembrane protein 41B
  Uniprot ID: Q5BJD5
  ENST ID: ENST00000528080
  CDS Start-End: 340-1215
tgctctcgccccagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttttctgttttgagacggagtctagctctgccgcccaggctggagtgcagtggcgcgatctccactcactgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcgtgagccaccgcgcctggcccattttcttcctcttttgaggtaatggatttgtttggagatggcatgttagtagacgactgaatatggaaaggatatcaagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataattttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccgtgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgttattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattg

SEQ ID NO: 194200 - DNA, 803 bp, Homo sapiens
  Payload ID: 18370
  Gene Name: transmembrane protein 41B
  ENST ID: ENST00000527813
  CDS Start-End: 190-780
agcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggtgtcgcacctccttcttttgtagccattaaggcaggaacaacactg

SEQ ID NO: 194201 - DNA, 723 bp, Homo sapiens
  Payload ID: 18370
  Gene Name: transmembrane protein 41B
  Uniprot ID: Q5BJD5
  ENST ID: ENST00000533723
  CDS Start-End: 193-576
tttagcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttgtatccttttaactgaaaaaatgttttctaattttgttcaagaaaaagtgtaaaaggtctgctcttcatttatacataactattttccttttaaaatttgttattgcagtgtgacaatattaaataattgaaaaattaaaatggaaaaaaattatcactttaa

SEQ ID NO: 194202 - DNA, 1440 bp, Homo sapiens
  Payload ID: 18370
  Gene Name: transmembrane protein 41B
  Uniprot ID: Q5BJD5
  ENST ID: ENST00000611268
  CDS Start-End: 127-1002
tcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattgtattggagaaacct

SEQ ID NO: 194203 - DNA, 1026 bp, Homo sapiens
  Payload ID: 18371
  Gene Name: transmembrane protein 42
  Uniprot ID: Q69YG0
  ENST ID: ENST00000302392
  CDS Start-End: 57-536
cggcgcgcgctctgccctgcgggcagcgggtgccaggcacggtgtcagcaggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcctccgccaagctggccttcggcagcgaggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtatcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaactacca

SEQ ID NO: 194204 - DNA, 1026 bp, Homo sapiens; identical to SEQ ID NO: 194203
  Payload ID: 18371
  Gene Name: Transmembrane protein 42
  ENST ID: ENST00000626748
  CDS Start-End: 57-536

SEQ ID NO: 194205 - DNA, 3341 bp, Homo sapiens
  Payload ID: 18372
  Gene Name: transmembrane protein 43
  Uniprot ID: Q9BTV4
  ENST ID: ENST00000306077
  CDS Start-End: 255-1457
tttgcagtgcgcaggcgcatcaatgaggtactgcaatgtcccggaccgtatagtttccaggacgtctcgccgcgcgcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggccacaaaaaccccagtgccatggcagtggagtcattcatggcaacagccccctttgtccaaattggcaggtttttcctctcgtcaggcctcatcgacaaagtcgacaacttcaagtccctgagcctatccaagctggaggaccctcatgtggacatcattcgccgtggagactttttctaccacagcgaaaatcccaagtatccagaggtgggagacttgcgtgtctccttttcctatgctggactgagcggcgatgaccctgacctgggcccagctcacgtggtcactgtgattgcccggcagcggggtgaccagctagtcccattctccaccaagtctggggataccttactgctcctgcaccacggggacttctcagcagaggaggtgtttcatagagaactaaggagcaactccatgaagacctggggcctgcgggcagctggctggatggccatgttcatgggcctcaaccttatgacacggatcctctacaccttggtggactggtttcctgttttccgagacctggtcaacattggcctgaaagcctttgccttctgtgtggccacctcgctgaccctgctgaccgtggcggctggctggctcttctaccgacccctgtgggccctcctcattgccggcctggcccttgtgcccatccttgttgctcggacacgggtgccagccaaaaagttggagtgaaaagaccctggcacccgcccgacacctgcgtgagccctaggatccaggtcctctctcacctctgacccagctccatgccagagcaggagccccggtcaattttggactctgcactccctctcctcttcaggggccagacttggcagcatgtgcaccaggttggtgttcaccagctcatgtcttccccacatctcttcttgccagtaagcagctttggtgggcagcagcagctcatgaatggcaagctgacagcttctcctgctgtttccttcctctcttggactgagtgggtacggccagccactcagcccattggcagctgacaacgcagacacgctctacggaggcctgctgataaagggctcagccttgccgtgtgctgcttctcatcactgcacacaagtgccatgctttgccaccaccaccaagcacatctgtgatcctgaagggcggccgttagtcattactgctgagtcctgggtcaccagcagacacactgggcatggacccctcaaagcaggcacacccaaaacacaagtctgtggctagaacctgatgtggtgtttaaaagagaagaaacactgaagatgtcctgaggagaaaagctggacatatactgggcttcacacttatcttatggcttggcagaatctttgtagtgtgtgggatctctgaaggccctatttaagtttttcttcgttactttgctgcttcatgtgtactttcctaccccaagaggaagttttctgaaataagatttaaaaacaaaacaaaaaaaacacttaatatttcagactgttacaggaaacaccctttagtctgtcagttgaattcagagcactgaaaggtgttaaattggggtatgtggtttgattgataaaaagttacctctcagtattttgtgtcactgagaagctttacaatggatgcttttgaaacaagtatcagcaaaaggatttgttttcactctgggaggagagggtggagaaagcacttgctttcatcctctggcatcggaaactcccctatgcacttgaagatggtttaaaagattaaagaaacgattaagagaaaaggttggaagctttatactaaatgggctccttcatggtgacgccccgtcaaccacaatcaagaactgaggcctgaggctggttgtacaatgcccacgcctgcctggctgctttcacctgggagtgctttcgatgtgggcacctgggcttcctagggctgcttctgagtggttctttcacgtgttgtgtccatagctttagtcttcctaaataagatccacccacacctaagtcacagaatttctaagttccccaactactctcacacccttttaaagataaagtatgttgtaaccaggatgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaataaatttctaaattat

SEQ ID NO: 194206 - DNA, 908 bp, Homo sapiens
  Payload ID: 18372
  Gene Name: transmembrane protein 43
  ENST ID: ENST00000432444
  CDS Start-End: 180-380
gcatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaatccaaaacctggaagctgtcaagatacccatccactgacgaatgattcagcacactgtggtatagtcataaatggaatactactcagccatgaaaaggaacaaattcctgataaacaccacaacatgaatgaattgcaaaagcagtgctctgagtccaagaagctgggcagaaaggagttggtgccctgattccatttttctcaagttgtagaagaaacaaactaatctacgtattccagtaccagtacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtggtgtctcccgacagcatccacagtgtggctccggagaatgaaggaaggctggtgcacatcattggcgccttacggacatccaagcttttgtctgatccaaactatggggtccatcttccggctgtgaaactgcggaggcacgtggagatgtaccaatgggtagaaactgaggagtccagggagtacaccgaggatgggcaggtgaagaaggagacgaggtattcctacaacactgaatggaggtcagaaatcatcaacagcaaaaacttcgaccgagagattggc

SEQ ID NO: 194207 - DNA, 1278 bp, Homo sapiens
  Payload ID: 18373
  Gene Name: transmembrane protein 44
  ENST ID: ENST00000330115
  CDS Start-End: 300-641
ctaattgctgttggctcaggaaatgtggacaatacgcaggaagggacgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgtgaggccgggggtggggatgggactgtgggtcacatgacagtctcagggcatctgggagcatcctgagagggtcatggggcggaggtgtggcgtcaccgtgggtgcatggacatgggctcagcttttcctgaagagcgttagtgtgtatgacagcaaggagggggtgtgtgtggagagtgggcagccaacccagggcgtcctgaggacggcgggagcctctcggggaaagcccgtgtgttcttccccatttcctatagcaaatgaaaagcaggctctgaggaagaagcccctgaggctgaacccataagagaaggagatttgacaccggacaggcagccaggtgtgaggttctgtgtagatcaagagtgtcttaggccgggcgcgggggctcacgcctggaatcccagcactttgcgaggccgaggcggggcgggtcgcttgaggtcaggagttggagactagcctgaccaacacggtgaaaccctgtctctactaaaatacaaaaattagccaggcatggtggtgcatgcttgtaatcccagctactctggaggctgaggtggagaatcgcttgaacccaggaggcagaggttgcagtgagccgagattgtgccactgcactccagcctgggcgacaagagggaaactccgtctaaaaaaaaaaaaaaaaaaaa

SEQ ID NO: 194208 - DNA, 2245 bp, Homo sapiens
  Payload ID: 18373
  Gene Name: transmembrane protein 44
  Uniprot ID: Q2T9K0
  ENST ID: ENST00000347147
  CDS Start-End: 111-1397
cggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 194209 - DNA, 2197 bp, Homo sapiens
  Payload ID: 18373
  Gene Name: transmembrane protein 44
  Uniprot ID: Q2T9K0
  ENST ID: ENST00000381975
  CDS Start-End: 67-1257
ggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaa

SEQ ID NO: 194210 - DNA, 2490 bp, Homo sapiens
  Payload ID: 18373
  Gene Name: transmembrane protein 44
  Uniprot ID: Q2T9K0
  ENST ID: ENST00000392432
  CDS Start-End: 207-1634
ggaaacttttccccggcgccttcgccgccgccgcccgcgcccgggagcgcgcccttctctgcccgcggtcggtgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgccccacctccgacactggggattacgactcaacatgagatctggcggggacaaatgtccaaaccatcccagtctccctcacgttctcccagcggacattggcgagccgctgcccagcgtcaggtgctgggcactgagatgtgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagtatctca

SEQ ID NO: 194211 - DNA, 682 bp, Homo sapiens
  Payload ID: 18373
  Gene Name: transmembrane protein 44
  ENST ID: ENST00000430601
  CDS Start-End: 135-500
tgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatt

SEQ ID NO: 194212 - DNA, 452 bp, Homo sapiens
  Payload ID: 18373
  Gene Name: transmembrane protein 44
  ENST ID: ENST00000429560
  CDS Start-End: 1-360
atgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgagtgggaccctgaagatgtgaacctcgaaggcagcaaagaaaatgtggagctactgggatcccaggtgcaccaggactctgtgaggacagcacacctgagtgatgatgattaa

SEQ ID NO: 194213 - DNA, 1445 bp, Homo sapiens
  Payload ID: 18373
  Gene Name: transmembrane protein 44
  ENST ID: ENST00000432352
  CDS Start-End: 1-594
ctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactgacaccgcggcaggaactgaagctgccctggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggatctcagacccgctcttccttttcccttcattcccttgagagtcagccatgaacggaatacctgctaggttccaggaatgagctcacctaacagatagcaaatgtgtctggttagatctcagcagagcccattctgcaagacctggctgagccagatgagagggtgggccctgtgctggggggccttgggtcacacacaggaaccgagacctggcttccaccccccagtcacccacttgggttatctgctggaagttatcgataggactgtgtggccaaccaagtgcttgtgagatcactgacactgcaaaaacaaagcaaactgctccgggtaccaggacttcctccaacctggcaagggtgtgcgctgaggcggggcttgcaggtgagggggctgtatgcttcaggaactaactaaatgcatgcagaaggtaagaggcatgatgggaggtgttcaagcacagcaatcccatttgggagttattttgatactgcgatgagtaagggtaagggcgcatggaatggggctaaggtgggagtgaacactggggtgaataaattttaaatcaattcaagta

SEQ ID NO: 194214 - DNA, 1212 bp, Homo sapiens
  Payload ID: 18373
  Gene Name: transmembrane protein 44
  ENST ID: ENST00000419280
  CDS Start-End: 255-707
acgccgtgccttacagcgaccggcagggactcggccgtccgcgagcccagccgcccgccccgctccggccaggatgttggaggcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattatggagtctcgctgtgttgcccaggctggagtgcagtggcgtgatcttggctcactgcaaccttcacctcccaatttcaagcaattctcctgcctcagcctcccgagtagctgggactacagctgccagtggagctgcaggagctgctagtggctcctggtgtcccttgatgcatggcagtgtcgtttacatttctgccttgcccttcatgtggccttcttccctttgtattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagcagaagtattgggaggccctaaactcggagcag

SEQ ID NO: 194215 - DNA, 846 bp, Homo sapiens
  Payload ID: 18373
  Gene Name: transmembrane protein 44
  ENST ID: ENST00000452358
  CDS Start-End: 1-786
aactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgc

SEQ ID NO: 194216 - DNA, 1508 bp, Homo sapiens
  Payload ID: 18373
  Gene Name: transmembrane protein 44
  Uniprot ID: Q2T9K0
  ENST ID: ENST00000473092
  CDS Start-End: 111-1427
cggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagaagtattgggaggccctaaactcggagcagtgggaccctgaagatgtgaacctcgaaggcagcaaagaaaatgtggagctactgggatcccaggtgcaccaggactctgtgaggacagcacacctgagtgatgatgattaacaccttctggagccagctcatcagctcagagcccagggtcaggagttcgttcagtaacgcagcgggaatcaatctgcactg

SEQ ID NO: 194217 - DNA, 1567 bp, Homo sapiens
  Payload ID: 18374
  Gene Name: transmembrane protein 45A
  Uniprot ID: Q9NWC5
  ENST ID: ENST00000323523
  CDS Start-End: 314-1141
gaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 194218 - DNA, 1910 bp, Homo sapiens
  Payload ID: 18374
  Gene Name: transmembrane protein 45A
  ENST ID: ENST00000403410
  CDS Start-End: 621-1496
gcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggggtgctatgggccaggtttctgaagttgggtggaggtggaggccaccggcagtgagtacaacgcccaggggaagcatgtgagtgggaggaagaaaagagagttttctggagctgttgcaatgtgtatgctggtgaaatctacttgagcattaagcagtatctcccagcattgttagctactgagtggcacatcttcagtacgcatgattcgtgggggactcaggcagaggtaaaagtgtgaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgta

SEQ ID NO: 194219 - DNA, 874 bp, Homo sapiens
  Payload ID: 18374
  Gene Name: transmembrane protein 45A
  ENST ID: ENST00000449609
  CDS Start-End: 301-874
cgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaaca

SEQ ID NO: 194220 - DNA, 2234 bp, Homo sapiens
  Payload ID: 18375
  Gene Name: transmembrane protein 45B
  Uniprot ID: Q96B21
  ENST ID: ENST00000281441
  CDS Start-End: 89-916
cctggagctgcacctgcttctgggcggacgcacttggcgcgcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacgtcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtgctgagaggcaagtacaaaccacgatg

SEQ ID NO: 194221 - DNA, 1639 bp, Homo sapiens
  Payload ID: 18375
  Gene Name: transmembrane protein 45B
  Uniprot ID: Q96B21
  ENST ID: ENST00000524567
  CDS Start-End: 282-1109
tttttttatgtttagtagagacagggtttcaccatgtttgtcaggcttatctcgaactcctgacctcaggtgatctgcctgcctcgccctcccaaagtgctgggattacaggcgtgagccaccgcacctggcctctcatgtttttctataagcagttaagagaagccacacagcatcctgaacactttgctttctatctcttctgccaaatatcctaggtcatcattcttaagttctgccctccatgaagtcctaggaaacgacataattcaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaa

SEQ ID NO: 194222 - DNA, 4054 bp, Homo sapiens
  Payload ID: 18376
  Gene Name: transmembrane protein 47
  Uniprot ID: Q9BQJ4
  ENST ID: ENST00000275954
  CDS Start-End: 260-805
ggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccggaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtttgaa

SEQ ID NO: 194223 - DNA, 1918 bp, Homo sapiens
  Payload ID: 18377
  Gene Name: transmembrane protein 5
  Uniprot ID: Q9Y2B1
  ENST ID: ENST00000261234
  CDS Start-End: 159-1490
gcgtgtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttctt

SEQ ID NO: 194224 - DNA, 1966 bp, Homo sapiens
  Payload ID: 18377
  Gene Name: transmembrane protein 5
  ENST ID: ENST00000537373
  CDS Start-End: 949-1500
cgaggtaggactgggtcggcggcttccttccggctctgcgctcctggctggggctgctgggcggctggggccgggtccccgcacccggctctcaagtccgggattacccgcagggcctgagaagcgctttgccccctacagcctctcgagccagcccttggctcggaattggagaatggtcctcattcttacccagatctcacacgccgtccccgctcccgatcccagggggtgacaggcgcgcacgcctttcaaacacgtgttaaaatccaagacgtcgtctcaaatgccagagatttgcgggaatgctcctggaaggcctcaaaatcgccgcaagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaattta

SEQ ID NO: 194225 - DNA, 1599 bp, Homo sapiens
  Payload ID: 18377
  Gene Name: transmembrane protein 5
  ENST ID: ENST00000543342
  CDS Start-End: 96-458
aaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattgtccaagctggcagcgtttctgctcataaaacattctgaagaaccttgtgggccctctgtgtatgtcacaggattcactccattagatgggaagctcctctgcagatcttttctgagtaatcccatctccatttctggcttctgctgagatggctgaggagacctgcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatcttt

SEQ ID NO: 194226 - DNA, 2683 bp, Homo sapiens
  Payload ID: 18378
  Gene Name: transmembrane protein 50A
  Uniprot ID: O95807
  ENST ID: ENST00000374358
  CDS Start-End: 554-1027
agaaaataaacaagactaaaaagtcctgagtagcgctgtgtggccgcaaacctgaacccaccttttgcaccacgcgggacccggcactcttcctgccacccacccctgagagggctgcgcggccgaccccagtactagaaaacactcgtcacctcactcaagacgggtacgaaggccaacggacgccttcctttagaacgctcagcacacagagcaacttctcacgcctactctcaaatggcgtactccaaactagcactcccgacgtccagctgtgaacccagagcggcggaaagcccctgaacccagcgcccgggcatgcgcagacgcgttgttgtggtgggcgtggctccctccggacccggcgccccgccctccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactcttaaactaa

SEQ ID NO: 194227 - DNA, 619 bp, Homo sapiens
  Payload ID: 18379
  Gene Name: transmembrane protein 50B
  ENST ID: ENST00000432504
  CDS Start-End: 376-619
ggaaagggaaggggaacaacattctttcgagaattataaaccttgagctccgttaaataagtagcagcagagcattgtcactggagcagtggtagtcgcgggtaggaccgtttcggtttttagccaataggctggttaaaggtacttaaaacagtaagttggaaggtgctgaaattctaagcatggtagcccaagcattagtgttccagagaaccaggcagatgctccattgccttctgtgacctgatcttggaagtggcatggagaagttacatagcatcacttcctctactctactggtctactagtctttattgttgacccaaattcaaaggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagag

SEQ ID NO: 194228 - DNA, 3062 bp, Homo sapiens
  Payload ID: 18379
  Gene Name: transmembrane protein 50B
  Uniprot ID: P56557
  ENST ID: ENST00000420455
  CDS Start-End: 148-624
gctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtatacccaattaaagatgcagttatgtttataaaataagaagaaatagacttgtaaaatgcttatgtgagggttattgaaggtttccctgaagactgactggaaatggtggctgtttttttctatttctgactctgccatgaatttttttttttttttttaaagacaatatctcactctgttgcctaggctggagtgcagtggtgcaaccacagctcactgcaccttcaaatgctggagctcaggcaatcctcttacctccgctttccaagcagctgggaccacagatgtatcctccactcctcgctggccaccatcctgctgcccaacagaagaagctcttctgtctccgatttcctgaacggtctaaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacatcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctcag

SEQ ID NO: 194229 - DNA, 634 bp, Homo sapiens
  Payload ID: 18379
  Gene Name: transmembrane protein 50B
  ENST ID: ENST00000441128
  CDS Start-End: 42-176
gatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattt

SEQ ID NO: 194230 - DNA, 982 bp, Homo sapiens
  Payload ID: 18379
  Gene Name: transmembrane protein 50B
  ENST ID: ENST00000442441
  CDS Start-End: 141-596
gggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaatgttggccataggaggcaaaggagcaagttactgcttcctcagcagttttgatgtagctagaaccagcaattactttgactaaaagaaaactttatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctga

SEQ ID NO: 194231 - DNA, 2375 bp, Homo sapiens
  Payload ID: 18379
  Gene Name: transmembrane protein 50B
  Uniprot ID: P56557
  ENST ID: ENST00000542230
  CDS Start-End: 216-692
ctgcggtgcacacggcgcctcgccccgcctcaccggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaa

SEQ ID NO: 194232 - DNA, 3062 bp, Homo sapiens; identical to SEQ ID NO: 194228
  Payload ID: 18379
  Gene Name: transmembrane protein 50B
  Uniprot ID: P56557
  ENST ID: ENST00000571778
  CDS Start-End: 148-624

SEQ ID NO: 194233 - DNA, 619 bp, Homo sapiens
  Payload ID: 18379
  Gene Name: transmembrane protein 50B
  ENST ID: ENST00000574612
  CDS Start-End: 376-619
ggaaagggaaggggaacaacattctttcgagaattataaaccttgagctccgttaaataagtagcagcagagcattgtcactggagcagtggtagtcgcgggtaggaccgtttcggtttttagccaataggctggttaaaggtacttaaaacagtaagttggaaggtgctgaaattctaagcatggtagcccaagcattagtgttccagagaaccaggcagatgctccattgccttctgtgacctgatcttggaagtggcatggagaagttacatagcatcacttcctctactctactggtcaactagtctttattgttgacccaaattcaaaggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagag

SEQ ID NO: 194234 - DNA, 2375 bp, Homo sapiens; identical to SEQ ID NO: 194231
  Payload ID: 18379
  Gene Name: transmembrane protein 50B
  Uniprot ID: P56557
  ENST ID: ENST00000573374
  CDS Start-End: 216-692

SEQ ID NO: 194235 - DNA, 982 bp, Homo sapiens; identical to SEQ ID NO: 194230
  Payload ID: 18379
  Gene Name: transmembrane protein 50B
  ENST ID: ENST00000573687
  CDS Start-End: 141-596

SEQ ID NO: 194236 - DNA, 634 bp, Homo sapiens; identical to SEQ ID NO: 194229
  Payload ID: 18379
  Gene Name: transmembrane protein 50B
  ENST ID: ENST00000572455
  CDS Start-End: 42-176

SEQ ID NO: 194237 - DNA, 1931 bp, Homo sapiens
  Payload ID: 18380
  Gene Name: transmembrane protein 51
  Uniprot ID: Q9NW97
  ENST ID: ENST00000376008
  CDS Start-End: 433-1194
agtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagtaca

SEQ ID NO: 194238 - DNA, 1843 bp, Homo sapiens
  Payload ID: 18380
  Gene Name: transmembrane protein 51
  Uniprot ID: Q9NW97
  ENST ID: ENST00000376014
  CDS Start-End: 486-1247
aaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtctt

SEQ ID NO: 194239 - DNA, 1842 bp, Homo sapiens
  Payload ID: 18380
  Gene Name: transmembrane protein 51
  Uniprot ID: Q9NW97
  ENST ID: ENST00000400796
  CDS Start-End: 416-1177
acgccggcgctcccaggccgcgcttcctgcgtccccaacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaa

SEQ ID NO: 194240 - DNA, 1942 bp, Homo sapiens
  Payload ID: 18380
  Gene Name: transmembrane protein 51
  Uniprot ID: Q9NW97
  ENST ID: ENST00000428417
  CDS Start-End: 447-1208
cagctgcctatcggcttctcagtgtttgaacttcaaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagt

SEQ ID NO: 194241 - DNA, 1861 bp, Homo sapiens
  Payload ID: 18380
  Gene Name: transmembrane protein 51
  ENST ID: ENST00000434578
  CDS Start-End: 454-861
caacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaa

SEQ ID NO: 194242 - DNA, 766 bp, Homo sapiens
  Payload ID: 18380
  Gene Name: transmembrane protein 51
  ENST ID: ENST00000451326
  CDS Start-End: 402-766
cgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggagga

SEQ ID NO: 194243 - DNA, 929 bp, Homo sapiens
  Payload ID: 18381
  Gene Name: transmembrane protein 52
  Uniprot ID: Q8NDY8
  ENST ID: ENST00000310991
  CDS Start-End: 9-638
ctcagagcatggcccgggggccgctggccgcccgcggactgcggctgctgctgccgctcctgccgctcctgccgctcctgccgctgccgcaggtggcgctgggcttcgcggacggcagctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaagtgg

SEQ ID NO: 194244 - DNA, 483 bp, Homo sapiens
  Payload ID: 18381
  Gene Name: transmembrane protein 52
  ENST ID: ENST00000378598
  CDS Start-End: 1-375
gggggccgctggccgcccgcggactgcggctgctgctgccgctcctgccgctcctgccgctcctgccgctgccgcaggtgggtcgggcggcgttctctctcggttcggccaccgcggggcgggtccctgctcggaccacgcccctcccgggctcacccttgtccccacaggtggcgctgggcttcgcggacggcagctgcgacccctcggaccagtgcccgccccaggcccgctggagcagcctgtggcacgtgggcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaa

SEQ ID NO: 194245 - DNA, 1118 bp, Homo sapiens
  Payload ID: 18381
  Gene Name: transmembrane protein 52
  Uniprot ID: Q8NDY8
  ENST ID: ENST00000378602
  CDS Start-End: 242-826
tccgctgtcgcccagtcccggccgctggcgggaactgacctggagcaagcaggaccttccctcccacctctcccgcctggcctccgcgggagtcccctacgatcccgctcagcagtggggcactcgctgaggacagcgagtcctgggagtgagcccaaggccacccctggccagcccaggagagatagccagggcaggcccagcagcccgaggccaggctctggccacggcggtctccgacatggagagacattgtctgctttttatcctgttaacctgtcttcggtggttgtgccacgacattccccagggtgcaggtgcccggtggccgagggtcagtccagtggtagagccttgctctcctaggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaagtggt

SEQ ID NO: 194246 - DNA, 313 bp, Homo sapiens
  Payload ID: 18381
  Gene Name: transmembrane protein 52
  ENST ID: ENST00000416272
  CDS Start-End: 5-313
gagcatggcccgggggccgctggccgcccgcggactgcggctgctgctgccgctcctgccgctcctgccgctcctgccgctgccgcaggtgggtcgggcggcgttctctctcggttcggccaccgcggggcgggtccctgctcggaccacgcccctcccgggctcacccttgtccccacaggtggcgctgggcttcgcggacggcagctgcgacccctcggaccagtgcccgccccaggcccgctggagcagcctgtggcacgtggggctcatcctgctggcggtcctcctgcttctgctgtgtggtgtcaca

SEQ ID NO: 194247 - DNA, 690 bp, Homo sapiens
  Payload ID: 18381
  Gene Name: transmembrane protein 52
  ENST ID: ENST00000470931
  CDS Start-End: 6-137
agagcatggcccgggggccgctggccgcccgcggactgcggctgctgctgccgctcctgccgctcctgccgctcctgccgctgccgcaggtggcgctgggcttcgcggacggcagctgcgacccctcggaccagtaagtcgggggggagggagccggggcctggccccgccctatggggaggcacgggtggcgaggtcggccgtcccatgccccgcctgctccaggtgccgccgtccccacaggtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgcc

SEQ ID NO: 194248 - DNA, 2731 bp, Homo sapiens
  Payload ID: 18382
  Gene Name: transmembrane protein 52B
  Uniprot ID: Q4KMG9
  ENST ID: ENST00000298530
  CDS Start-End: 579-1070
cacggagagagaagaaaggagattagcagggtgactttcaccctgcaacagtcacgctggagtactctggtgaaggatcaagaatattaccagttttctgatgaagaaaggaatatatttggtcaccagcaatctgcctttgaccatcctcaaagccaagtttttcatcgctgtctagaaaaatacttcattcagaggacacatatgtcctctttgaatgtctcctttttgggagcagtaggagaaagaaacttcaagatgtagaaagaattaatagtgtaacggaaagaaagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgttgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatacttttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtgtcttgaattcctttaactattgagtgcatatagaattcctgtacccacatgatactgcaagttgtgtctctctctgtcagcgaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctagaggagccatggtggaaaacacactctctcctttgagcctatctgcacatctctcgagttcttggagcaaaaactaaatgctgaactaagcctggttgagatgcttcccatggaccatgccgcagcacagtgctaatctatccacaaaacataccacctcccaaagtattattattggaaaatcgaggaagtgacgcacatttagggaaaaactactcaccttagaaaagtcactgaaatccttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttggcctcccaaagtgctggaattagaggcctgaccccctgctcctggcctgaaatctttaaagccgttttttccctaaaaaatgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgattgcggtaaacagcaac

SEQ ID NO: 194249 - DNA, 2601 bp, Homo sapiens
  Payload ID: 18382
  Gene Name: transmembrane protein 52B
  Uniprot ID: Q4KMG9
  ENST ID: ENST00000381923
  CDS Start-End: 405-956
agtgccatggcgccatctcaggtcactgcaacctccgcctcctgggttcgagtgattctcctgcctcagcctcctgagcagctgggattgcagccgcgcaccaccacagcaggttaaattttgtatttttagtacagatgaggtttcaccgtgctggtctcgaactcctgacctcatgatccgcccacctcagcctcccaaagtgctgggattacaggcgtgagccaccgcgcctggcctcatcactcttaaataatgaaaaactaaatttttagaggaaaaagaaaatcacaggaccctgtgaaggaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgctttctgggacgagatgtgaggaaaactgtggtaatcctgaacattgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatacttttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtgtcttgaattcctttaactattgagtgcatatagaattcctgtacccacatgatactgcaagttgtgtctctctctgtcagcgaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctagaggagccatggtggaaaacacactctctcctttgagcctatctgcacatctctcgagttcttggagcaaaaactaaatgctgaactaagcctggttgagatgcttcccatggaccatgccgcagcacagtgctaatctatccacaaaacataccacctcccaaagtattattattggaaaatcgaggaagtgacgcacatttagggaaaaactactcaccttagaaaagtcactgaaatccttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttggcctcccaaagtgctggaattagaggcctgaccccctgctcctggcctgaaatctttaaagccgttttttccctaaaaaatgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgat

SEQ ID NO: 194250 - DNA, 542 bp, Homo sapiens
  Payload ID: 18382
  Gene Name: transmembrane protein 52B
  ENST ID: ENST00000543484
  CDS Start-End: 273-542
aagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgctttctgggacgagatgtgaggaaaactgtggtaatcctgaacattgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgct

SEQ ID NO: 194251 - DNA, 890 bp, Homo sapiens
  Payload ID: 18383
  Gene Name: transmembrane protein 53
  ENST ID: ENST00000372235
  CDS Start-End: 53-796
cgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccc

SEQ ID NO: 194252 - DNA, 2310 bp, Homo sapiens
  Payload ID: 18383
  Gene Name: transmembrane protein 53
  Uniprot ID: Q6P2H8
  ENST ID: ENST00000372237
  CDS Start-End: 165-998
ggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactttgtgcctgttaccagagttgagttttgattccttgaatggaaggtgacctttgtggggagatgccagagggaaggtatatcggtcaggggtagcgtcaggctgcggataggggctatgatctttgctccagcagggcgaagccctacagtgtaaagtaccattcacatggctcccacttggcagttcactcagagaggctcctctgaccccattgcctgggagtctgaggtagaagccagatgaggagctgaggttaggggcctgcctggctctaccacactttgctaggaagccgctgggtctgggaaagttgcaagctgaaagttgccagagacagtggggggcaggaaggcagcagcattgtaacaggagctgggatgagctaactcccaagccctaaagaccagaaccagggtaaggggatttgggctgaaatagcaaactccttcatcttctggaagggagacccacttagatactctctaggcagaagaggtgaattcagcctgatagttcagtatcattgatcattctagaagtcactactgcacaatgttggcatatagtaggtattcaataaatatttgattgaatgag

SEQ ID NO: 194253 - DNA, 1846 bp, Homo sapiens
  Payload ID: 18383
  Gene Name: transmembrane protein 53
  ENST ID: ENST00000372242
  CDS Start-End: 69-674
gggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattcaggggcagtcagcagctagtgtcgggggaagggagcggggaaggaaggtgggtggtgatggcccctctaccttagaaaggcaatgctccacatgcctactcatctcctgctccgatcctgccagggggcggttgcacaggggacatacctgcccttcatcttgcttcctccgtttcattttcccaatccgagctgcacggggaaaccgaaaacaaagcacagaacaagcagacggtcactgcagcccccagggtcccagtggagctgacacatcctgacctcttgccagccattggcctttttattcagtgcctgatctggccctcatcttgaaatacctcctgctcctttggggactgggctttgccaagagcacctggggaggagactggtgctaactaagccagtgagtaagtccactctttggctgcagctggtgcaaggtctacccatacctttctatttgcagtgtttaataaaaatccagtgagcaaagaca

SEQ ID NO: 194254 - DNA, 1579 bp, Homo sapiens
  Payload ID: 18383
  Gene Name: transmembrane protein 53
  ENST ID: ENST00000372243
  CDS Start-End: 72-407
cccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaagggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattcaggggcagtcagcagctagtgtcgggggaagggagcggggaaggaaggtgggtggtgatggcccctctaccttagaaaggcaatgctccacatgcctactcatctcctgctccgatcctgccagggggcggttgcacaggggacatacctgcccttcatcttgcttcctccgtttcattttcccaatccgagctgcacggggaaaccgaaaacaaagcacagaacaagcagacggtcactgcagcccccagggtcccagtggagctgacacatcctgacctcttgccagccattggcctttttattcagtgcctgatctggccctcatcttgaaatacctcctgctcctttggggactgggctttgccaagagcacctggggaggagactggtgctaactaagccagtgagtaagtccactctttggctgcagctggtgcaaggtctacccatacctttctatttgcagtgtttaataaaaatccagtgagcaaagaca

SEQ ID NO: 194255 - DNA, 1472 bp, Homo sapiens
  Payload ID: 18383
  Gene Name: transmembrane protein 53
  ENST ID: ENST00000372244
  CDS Start-End: 87-323
ggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagagtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattcaggggcagtcagcagctagtgtcgggggaagggagcggggaaggaaggtgggtggtgatggcccctctaccttagaaaggcaatgctccacatgcctactcatctcctgctccgatcctgccagggggcggttgcacaggggacatacctgcccttcatcttgcttcctccgtttcattttcccaatccgagctgcacggggaaaccgaaaacaaagcacagaacaagcagacggtcactgcagcccccagggtcccagtggagctgacacatcctgacctcttgccagccattggcctttttattcagtgcctgatctggccctcatcttgaaatacctcctgctcctttggggactgggctttgccaagagcacctggggaggagactggtgctaactaagccagtgagtaagtccactctttggctgcagctggtgcaaggtctacccatacctttctatttgcagtgtttaataaaaatccagtgagcaaagaca

SEQ ID NO: 194256 - DNA, 415 bp, Homo sapiens
  Payload ID: 18383
  Gene Name: transmembrane protein 53
  ENST ID: ENST00000420706
  CDS Start-End: 12-415
gcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggc

SEQ ID NO: 194257 - DNA, 871 bp, Homo sapiens
  Payload ID: 18384
  Gene Name: transmembrane protein 54
  Uniprot ID: Q969K7
  ENST ID: ENST00000329151
  CDS Start-End: 152-661
gcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtgggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 194258 - DNA, 999 bp, Homo sapiens
  Payload ID: 18384
  Gene Name: transmembrane protein 54
  Uniprot ID: Q969K7
  ENST ID: ENST00000373463
  CDS Start-End: 121-789
cgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 194259 - DNA, 2970 bp, Homo sapiens
  Payload ID: 18385
  Gene Name: transmembrane protein 55A
  Uniprot ID: Q8N4L2
  ENST ID: ENST00000285419
  CDS Start-End: 316-1089
cccttttctctggctggctgggctcccgctcctccactgctgctcctcccactctgcgggttctttctttctccctcccctcccctcccccagccatgcctcccagcgcgcttcccttcccccgcctcctggtcctgcaccctcccctcccctccccccgcttcctgccttgtgacacatcccgggccctcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatattccttctggaataataactttatgagagcaagaaccctggtagtcttgttcacagctttatccccacttagaacagttcttagtgtacatgtgctcaatttacgtgaatgaatatgcatgaatgaataaatggttgaatgaattgctattttaaattctta

SEQ ID NO: 194260 - DNA, 838 bp, Homo sapiens
  Payload ID: 18385
  Gene Name: transmembrane protein 55A
  ENST ID: ENST00000520014
  CDS Start-End: 87-838
ggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagtgactaatatcttttcagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattgggg

SEQ ID NO: 194261 - DNA, 841 bp, Homo sapiens
  Payload ID: 18385
  Gene Name: transmembrane protein 55A
  ENST ID: ENST00000518869
  CDS Start-End: 124-294
cggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagaggtttactaactgtggaatctccagaattacaagtcccatataagaggagatggagctacaagtaaatgtttccttgagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccc

SEQ ID NO: 194262 - DNA, 867 bp, Homo sapiens
  Payload ID: 18385
  Gene Name: transmembrane protein 55A
  ENST ID: ENST00000518359
  CDS Start-End: 63-563
caccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcct

SEQ ID NO: 194263 - DNA, 649 bp, Homo sapiens
  Payload ID: 18385
  Gene Name: transmembrane protein 55A
  ENST ID: ENST00000520709
  CDS Start-End: 103-276
ctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctca

SEQ ID NO: 194264 - DNA, 171 bp, Homo sapiens
  Payload ID: 18385
  Gene Name: transmembrane protein 55A
  ENST ID: ENST00000630164
  CDS Start-End: 1-171
atggctgctgatggggtggacgaacgctcgcctctgctgtcagcatcccactccggaaatgtcactcccaccgccccaccgtacttgcaagaaagcagccccagaggtttactaactgtggaatctccagaattacaagtcccatataagaggagatggagctacaagtaa

SEQ ID NO: 194265 - DNA, 1961 bp, Homo sapiens
  Payload ID: 18386
  Gene Name: transmembrane protein 55B
  Uniprot ID: Q86T03
  ENST ID: ENST00000250489
  CDS Start-End: 288-1121
tgtgcgtcgctccccaatggaaaaggagagctgccttcacaggaccaggaattggtttatctacgcgaataatagcatgacccgggcggggatagcctatcacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccgcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactctacgctttttcagttgttaacttgtgtgcatgaaaatatgaggaagagaatgtgtagccccacgaaggggtaagacacgaagacagcaaggctgaaactatggctctttattttcatgtggataattcaaacaaagtcatt

SEQ ID NO: 194266 - DNA, 1696 bp, Homo sapiens
  Payload ID: 18386
  Gene Name: transmembrane protein 55B
  Uniprot ID: Q86T03
  ENST ID: ENST00000398020
  CDS Start-End: 141-995
gtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccaggcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactcta

SEQ ID NO: 194267 - DNA, 811 bp, Homo sapiens
  Payload ID: 18386
  Gene Name: transmembrane protein 55B
  ENST ID: ENST00000553460
  CDS Start-End: 1-337
gagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactcta

SEQ ID NO: 194268 - DNA, 277 bp, Homo sapiens
  Payload ID: 18386
  Gene Name: transmembrane protein 55B
  ENST ID: ENST00000556093
  CDS Start-End: 147-277
cagtgggggtgtaagtgatcccagcccttctatttgcttcctctccagcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcg

SEQ ID NO: 194269 - DNA, 6822 bp, Homo sapiens
  Payload ID: 18387
  Gene Name: transmembrane protein 56
  Uniprot ID: Q96MV1
  ENST ID: ENST00000370203
  CDS Start-End: 292-1083
gcggccgcggcccctttaaggagcagctctgcggtaacccgagcccgcagtccgggcgggcgcgacggccgccgcggtagctggagcctccgcgactgcacctccaagcggcccggaacccgcggcttccctggctcccgtgagcatctcaccgggcggcactggccagcgccagccctcgggccggcccggatgagcagactcctgtagacacccgccgccctctcccggctcggcgcagccgccgcccgcgcgcgactcgccccgggacccggcacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcggtggttctttgaagctctgaagtatcccaagttttctaaagctatcgttatcaatggaatactcatgacagtagtattcttcatcgtgcggattgcctcaatgcttcctcattatggcttcatgtattccgtgtatggaacagaaccctacataaggcttggagttttaatccagttatcctgggtcattagttgtgttgttttggatgtgatgaatgtcatgtggatgatcaaaatttcaaaaggttgcatcaaagtcatctctcacatcagacaagagaaagccaaaaatagtcttcagaatggaaaacttgattaaaagagtgctaccgataagcaaacttcattactacccagcatatctgctgataggatgaattcttggcatgttcttgtgtacctttcttaattataattgttattcaggatttcagtgtcattttttttaaaccttagaaaagagaaggccgggcacggtggctcatgcctgtaatcccagcactttgggaggccaaggtgggtcgatcactgaggtcaggagttcgagactagcttggccaacatggtgaaacctcatctctactaaaaatacaaaaaaaagtagctgggcgtggtggttggcgcctgtaatcccagctactcgggaggctgaggcaggagaatcgcttgaacccgagagacggaggttgcagtgagctgatattgtgccactgcactccagcctgggcgacagagcaagactctgtctcaaaaaaaaaaaaaagagagaaactaaaattaaaatttagttttcatcccaagatgtcttttctgcctttcttttgccttatttacaagcatggataaaaatcttaaaggtttaaataaaaatgatcaatataatggtgaatcttttgagaaatctcttaactgcattggtattttttctctgtgaaagatgactatgataatctggtacaaatggttttatgtcaccaattttgctgcaagaatgggaactgcttttaaatctgtaaatagctcttaacatttgttgtatgcactcttttcttactatggctgtcaacacttgtgtagggtttaatttctaaattgttggcatgttctttttctcaggctattcagaagtaacaacatttttcatttcagacatgcaatcacctattaatgatgaaatattttaccactttgggaatatttaattagtttagtcatggagaatacttcccacattttaagattttttcaaatatcactgtcatttctattttagcattttatcaaattattgcttttttattttataataaggcttaagacagattatagacctccttaagagatgagtttcttcttctaaaaatgcatgttgatagaggactatttaggctaatcggaggaatcattaagaaagaaagttttaacactgtttatccctatctgctttccttgcactttttctgtgaaaaatattttctgtttgcaaaatcttccctgagttctgaacccagcaccatcagtaccaaagtcttatgcaatatgtatttattatgctcctgaaataggcctcttcttgatgagacccaaactattacaaaaatatcagtattcatattttactcacaattcatacccgtgcttacttagttggcattttagtgctttgaatttctatcttaaagcacagaaaaaaaaaggtaatttaatccaagtattctatcatcaaaattattgtctgattatatgaagataaatgactggcgactctggttgtgtgtgtatgtgttttgcttttactttaattcttgcaatccaaatatagaattatatatttatctattattgcctttattctttaagcacttgagtttaatgattattcttacctgagaaaggaagaaatttaattctaccagtgatgaatacttgaaattaattgaactcataccaaaagatgtaatccagtttctcagtttgaaggagaacgtttgactcactttcattgttcatgctagctgaatataatcaagacttttgatttgatttgcttttattattcaatgcagatagagcctgataagttttagaacatttaaagaagattgaaatctcagtcagtaactaaatgataaaatgagattgattggcttatactaggtacatttatttttgaaagaattaatgtaaaataatagttatttttaaagcagctaatattacactgataatttgttgctaaatttagtgctgtccacatcataggtgcttaaatatgtactggttaactagaggggggtaggaaagcaagcggttttatcttgttcttacctttttgcaggaaaagtggctttaaaaaaatttatataataaaactattttggaaattcattcttttagaaagagaccttgagataaatattttttgactctggatatttctatagttctgaacacagattttaaacccactatcaaaatgaaaacaatataaagctatattagtgagtctccatgtagcagtttgtttttatagttactgtttcatgcttaaaacttcattcttactttcattaatgttacccttcactggtatagccactcactaaataagtatatttaaaacatcaaaattttgaactaaagtttgtgattctcttattcagcaatccttatcttatgctggctgcatgagttaattcaacatccagattaaatatcctgaagtaggttctatatatttcctcatacaacagacatggaatggaaatgccactagaaactgccctgctacttttaagtctgacctttgcaggaggtacactttgctgttctatgattgtattcacctacctaaaatacaaatgaagacagaacatatcatttactgcacgatgaatttttcatttattaaatgaaaaacgtttgctagacattttaaatattaagtattttgactacacggattaatttaaatgattctatcaggcattctgatatttaacaactctattaaaatatttatagaaaaataaaagcaaattgatataaatttttgagcaattctatttttgtagaaaaaagataacctgtaattataaagatgttttttgaatgtgtagtatcctagaaaataaaagttcttgtgaaacttaaaaaatgaatgaaaaccaactaatagcatgcaagatcatagatcctgcattaaatttttatttgtgaaaatttgaaaattatgagctataacttataaagtttgccttcttatgtctaaaatcttttaaaggattatttgcatttatgtaaaactggaaatgaagttatatatgagtgcaaagaaattgacttctgctcaaatatgtgttgataccctacagtaaattgaattaaatttttatcccaactgtttgattttattatttcatggactagccttacgttaagtgaaatactatttatgttgttaccacccctaagagtgactctgatatattatggatgacccaggacggtcttaaaggtctagttttaaaaactgcctagtttgtaagtatttgaatccagttcttttctaaattttaataatttgactcaaaatttttgctacagggtcaacttttaaattgtatatttcctctgaggcacactgggcatttggagaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatgtgtttggattccataagaagttgaacttagataattttatcaagagtagcacagtgtttctcaggtgcgagccagcatacagcgagacccttcatgtgtctctggatgcacatatatcttcccaaccttaaacacagctcattgaaatacattaaagctactgaaagtgagttctgatgcaaaacacatgtgaggtgtgtaggaacaatgaaaagctagaggatctggagttagaggaggcattgagagtgcttttcccttaaacgccgtgatagtcctcccttgatctagaagtattctctttgaatccttccatctcttcctcctggtacaccagatgacttcatcagcatctccctcttttatgctaacacctttcgctgtcaacttttgagacctccccatgtatctataagcttcccagtctcttatggcaaatttaaaagtttacaaataggttctctcattgaaaaaaagcattgtagtaaagtttaaagtggagctcagacaaatcatgacttattaagagactacaggaagccattcagcatttaataataactgtttacaacatgaggcaaagctaataatgttatggttttattaagagatctgtcatctctgtttttcttaaactggtttaacagtcagagctttgtaatgtgtttcagctgaagatttattataggcttgtaaattatctaaatgttctttttagaccccatgacaggagcacagaggaactgagataactctgtgttatgagagggtggatgctggcttgtgccaaaattattttagagtcctgctctttagggaaaactttgctatggtaatgtttctttgaaaacaaatttaccagcaactgcgttacttggtgttttccaaagtacaacatccaaggcttgaaccttacccgtttctaggccagactaggccagcctctagttttgataataattcatacctttattggaatatattttggatagcagtgaagaattgaaagcagctcctaaagattggtttgtttgctttgaaaatgtttacacttattcactctaagcagtggaccattttgatatcaggccctatacataagaccaaaaccagaaatatttctaaatctcaaagatttataagtacagtacctctggctgaaaactcgttaaacatctttggatattttttctttatatctttatgtaattatttctgtaattaagtgtacattagggttatttgctacttaacaagcctaaaggtatagctgtatatagaatgtgctctgtgtttttctgtttcctgcttggtttgtttctggtatgactatgtctactttttatttaaggaattttgtgtagataatactctcactaacttgtaaataggataagttatgagattttttggtattagaatttgtaataataatgacttttagattttatttgaaaaagctacttggaaagcagtaaatagaactatagtgatatatatagatacatagatatatacttttttctgagaatgtataatatataattgtcaaagatttttggaagtctttcaaaatatacttaataccattttgagaacataccttctaatttatttccataaggctgaagaacttttatttacaaaatgtaagactagataatgtatgaatcagtgttactaggacttatcagtacttaaaatagcaacttggcattctttattttgtttcctggttgttttatttggagggataataaatgtctaagttatttccattaaaattttgaaatgtttgtatactttatgtgtgccattttaaagtatatgcaagttctaagcaataatctgcatgttatacaaggttgacatattttgtcctgaaatttttagttaacatttcaagaatgataaaatgaacaccctgtaaattacccttctccccctcccctccatgaaaaccttgggattttcttgtgctagaacactaccacaatgtggtgcaaagctttgtattttgtggaaaaaaacaataaaatcacaattatttagtgcaaaa

SEQ ID NO: 194270 - DNA, 992 bp, Homo sapiens
  Payload ID: 18387
  Gene Name: transmembrane protein 56
  ENST ID: ENST00000456991
  CDS Start-End: 531-992
ctccaagcggcccggaacccgcggcttccctggctcccgtgagcatctcaccgggcggcactggccagcgccagccctcgggccggcccggatgagcagactcctgtagacacccgccgccctctcccggctcggcgcagccgccgcccgcgcgcgactcgccccgggacccggcacaggtgacgccgtttggagggggggttggggaggaaggcgggcttgcctcgccccgcggctcccccgcgccagccgccaagcgcagcccgcggagaggggtgccgcggcttcccgcccctggcctagcgcggccgagagctcctgcgcctggaggctgggtgggcgtccggcgcgcgggaggcggcccggggctcccgggcgggctccggcaggtgcagaactcacatagatgaaatgatgggacagatgcagaagaggggactttccaccagttctacttacttcaaagcaaaatgattggctttaaggaaaaggaaacgtgcaaggagtgaacttggatatgttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgttt

SEQ ID NO: 194271 - DNA, 609 bp, Homo sapiens
  Payload ID: 18387
  Gene Name: transmembrane protein 56
  ENST ID: ENST00000455656
  CDS Start-End: 181-609
ccgggcgccccgcattcctctcgcgtttctcgggctgcacgattccggctgccctgtctgcctggcggtgcctctcgggtctgagcttaaagcgggtgggtgcaaacctttgggcatccagggagagctttcttgttagagcccacacacaatcgggcgcatcaagtgggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaat

SEQ ID NO: 194272 - DNA, 3917 bp, Homo sapiens
  Payload ID: 18388
  Gene Name: transmembrane protein 57
  Uniprot ID: Q8N5G2
  ENST ID: ENST00000374343
  CDS Start-End: 180-2174
ggaggaggctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaa

SEQ ID NO: 194273 - DNA, 3294 bp, Homo sapiens
  Payload ID: 18388
  Gene Name: transmembrane protein 57
  Uniprot ID: Q8N5G2
  ENST ID: ENST00000399766
  CDS Start-End: 242-1555
aggcggctggctggtgctgggcgggcgggccccggaattgtcatttctttgtttccgaaggcggaggaggctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagat

SEQ ID NO: 194274 - DNA, 6691 bp, Homo sapiens
  Payload ID: 18389
  Gene Name: transmembrane protein 59
  Uniprot ID: Q9BXS4
  ENST ID: ENST00000234831
  CDS Start-End: 251-1222
aggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaatttgagtatctgatttttctagaccttccctcctattcctgcccaacctagataagaattatgaaatgttctgtgtttattgctattgctttataatgtgatggtcagggaccattttgatgcaaaactgatctctcagcagtacatttgatgttattttgcacaggctataggtttttgtttgatgagtgtttccaaagaactatttttctctgttagatagcatatcaagtataaggtaaacatattttcagagaaaacttcattttaacactaaaaattagactcttgtgatacagaattaagtataaattttacttggcaaaaactcgttttatttttacctgcaataatacagagcttaatattagaatgatatcaggtcataataataatacaccagaatcttttgagatggaattttgctcttgttgctgaggctggagtgcaatggtatgatcttggctcactacaacctccacctctgaggttcaagcgattctcctgcctcagcctcccgagtagctgggattacaggcatgcgccaccacacctggataattttgtatttttagtagagacggggtttcaccaggttggccaggctggtctcgaactcctgacctcaggtgatccacccacttaggccttccaaagtgctgggattacaggcgtgagtgactgtgcccagcctacaccagaattctaatatgattcactgttattatgccataaaatattaaaaactttgtaaaacaatactttcctcagtcacaggggcattgctgacaactgcatcagtgctgtttgactaaagaataagttagtcactcctcctatggcctagtctttagccttcctgagtccaaatgaaaagcagttaacagctaatcaaggaagactttggtcacaaagtgtaggtttttatttttagtttgtctagatttggatgatagaaagttgtgaacacatccagatggggaagaaaggaggaattagccgtcattgtcaagcagtcattgtttctttcttctttttgttagaaaacatgggataaaacgtggggactcagccaggcacagtggctcacgcctgtaatcccagcactttgggaggccaaagcaggaggatcacttgaggtcaggagttcgagaccaacctgggcaacatagcaagaccctctctgtacaaaaaaatacaaacaaacatggggactatataaaacatgggtagtggataggagttaccattaaaaaaaaataaaaagccctgttgtttcgtctcccatcattagtgcatacttagtttccttagtcaggcacaggtttaattgtaatgcatccaatgaagcaaacagagaaacacaaaatgctgctgtctcacaggaatcaaagagcccactgttagaaaagaccctcccttataaaaacaaaacaaagaattatctagatcacttggggccaggagttcaacaccatcctgggcaatataatgagaatcccatctttttttttttttttaaagcaactgtacagttgtcctatattctccaccttcccttggtttcatttctcttcgcttcctgaatgagaagtgcctgagataccttcatttctcttgaaagtattgatccaagtttagacaaatatctcccctcttgttgagagaattccttatatgtgaaaataccaagacattcttgatatttagcaggcactcaaatatttgtctcctcttttttagcataattaagccagactgatgtttgcatttgagtatcatcagcatgagtaaccattttaatctctcttcccttaactacttgttctacactagagtctagggtcagggtacgtacagtgataaagattgagataatgggaaatatagtcttctgtttgggaagctggattgtagtgttgattttctgactccttgtggtaattaaattctgaagcacagaatctacttttgagaagaaatattttacttttgaaaaaaaatccccaaaatatatacagcataaaaatgtttccgatcttgaaaatcccaaccaaagcaacaaaactgagcttccaagccccttctcctaaagtaacagttttgcccttcttggatgtgcctaactttacttagctccttgtttccataaaacagtcataatcttatttcctaccacacagaaagcatcttgagaatctggtcttggtcctaggcaaattctcaagaccgttgggtctctggttcaaacctcccagacttctaaggtctttcttggctcaggtccctcatctaagagacatgctaattcaggcaattacaaaagcagtactaatcaccataatgaatgatctgggcctaggttccaagttttctcacaaaacttcatgggcacctttcatttgtgatatgttttgtagtaaatcagaaattactagatgatctggtcaatcttatctcagaaatccctgtggtgcatcatgaggcaatctgagctgctgatcagcagaaaaccctgcactgtctgagcttatcttccagccaaaggcaaacaatttaccctttgttattagtctgtctggatttgtcttagataaatgagccatttttgttacaagttttttaaagatatacagtagttccattataatttttgtggactcaaatatcaagtccacatgtagggaatcattgacagagatttccagttactgtcaccaccacaccaaggcagtaattttgctcagttctgcctttatagatccacaatttaaccattcaacaaccacctgagatcctgagtggcaggccctatgctaaatgctaggaccacagtaagacccagtgcctgaccccaattgctgagactctgaaggagactattattaatgtgataagtgctatgaccaagcacagagcacataggaggagctgtatgcattatgggagcacacaggaggacttctgggagaaagtgatagccaagcttaaacctggagaaaaagggaacgccaaacacaatatagagagcagtgtaccagacagtggggacactgtgctcaaagacctagaggccagagggtgaggcactgcagattgttgagtaggccgagatagagcatacaaaagcataacaaaagatggggctaggcagaccaggtaataaacctgcactttaaacctgcacttgatcctgagcacagtagagagccactgaaagattttaagcaagagagtgccatacagtgttggaatgattcactcggacagcaatgtggaagatagaccagaaagggcaagtccagaggccaacaataatcttagcctcagagttctttttttaatacccaagaatactatttcattttacttatatttttaaacttttctctataacgctctctctgctcccccacattgttgtctggatggtaaacctaggactggtctctgagtcctggtcacagcctggcaacagaatgtttgagcaaactgggaaggctgccccatggatccctggtttcttatcaccatcctcttaattctacgtttgccaaccagtctctaggaagccagcgtgctcttgcgcccctcccaccaggtttccagttgctaagcgtgtcatgtttgcatttgggtatcatctgcatgagtgaccattttaatctctctttccttgactacttgttctacactagagtctagggtgggggtgagtacagtggtaaagacagggatagcgggaaatttagtcttctgtttaggaagctggatggtagtgtggattttctaactccttgtggtaattaaattctggagcacagtttttagaccttttctgaaatctgttactgttgaagtcagcttcatatatttcactttttttttttttgagacagagtctcacactgttactcaggctggagtgcactggtacaatcttgactcactgcaacctccacagctcccaggttcaagcgattctcgtgcctcagcctcccaagtagctggtactacaggcgcgtgccaccatgcttggctaatttttgtatttctagtaaagatggggttttgccatgttgcccaggctggtctcgaactcctggcctcaggtaatctgcccgcctcagcctcccaaagtgtttggattgcaggcatgagccactgcacccaccctatttcactattaagtactctcttcctgtgatattaatgacttatttgtttcaaacttttttgtgccattgagctttttagtgatccagtgaagcctgtggaccccctctcatagtaatgttttcaaagcataaaactaaatataaaggatcgcaaaggaaactgatcatgttaaaataaagttgatattttcaaagttttatgatccagtaacatacatattctgttaacacaaaataagactgcatggtggttctaaaattactataattcaaattcatatcttgaaatatctaacaactgtaatatatctaaatgtctcatttctattggtgacaaagtcacaggtactctgatcctactgtggactgtttcctatattcgtaattgaaggaaatgttatatttcagttagaagttggtgaaaagaaagatttaaaatttttcccatccaagttcaccagacccctggtttagaggttgtcttaattttacttttgtcattttaagagtaaattattttgttttcttgttcaattctcaattatttgggcttattttactgcctcttgcatgcttttttatgcttgaatggtttttgcagtgttagaacagtaataattgaagacttgggtggaaaaaaatcagcacctgattgaaaatgaaaggtttcaacaaaagctcttgataatgttacctccaggtgtaccatcatgccaccattattggtgctacaaatctgttaatttatttatgcttaagtatgtaaactttaataaaacttggatcatctgcattaaaaaataa

SEQ ID NO: 194275 - DNA, 600 bp, Homo sapiens
  Payload ID: 18389
  Gene Name: transmembrane protein 59
  ENST ID: ENST00000371337
  CDS Start-End: 5-442
caagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaagtacgaaacaatactgcctttcaaactagcctgcttagatggcactgacttgtattgcttgaagtgtttatcacccacttgatcctattttagtgttatattttatatttggctttcagcaaacaaaattagtttgcaaatagaaaagtcagttgaataattgcttttgtataatgctttactattaaaagttatgcttacgttca

SEQ ID NO: 194276 - DNA, 1116 bp, Homo sapiens
  Payload ID: 18389
  Gene Name: transmembrane protein 59
  ENST ID: ENST00000371341
  CDS Start-End: 354-932
accgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaag

SEQ ID NO: 194277 - DNA, 2473 bp, Homo sapiens
  Payload ID: 18389
  Gene Name: transmembrane protein 59
  ENST ID: ENST00000371344
  CDS Start-End: 1421-1999
aatgtagccaaggttactaatgcatagatatgttatgcgtatacaaggatgtacacatatattttgtaaatataagtatacataaagagcttctactaatttttttctactacataatattctgtgtagatatattataattttttaggcagtcccttatttgtgaacatgtaggttgttcctaatctttttcttttgtaaatgatacctattttgcacatttgtgagtatacctgtagaataaaatcatagggctagaattgctgagttaagaggtatatgcattttttatttttatgttttttagagatgaggatctcactatattacccaggctggcctcaagcttctgggcccaagtgctaccatagataccactgcactccagcctgggtgacagagcgagacactgtctcaaaaaaaaaaaaaaaaaacagatgaaaaaagaaacaaagcagaaccaaagctatccctagagtttagtaaatggcatcccacacttgtgctttagagaggcccagtgctgctaaagaagtcaagaaatcagaattggaggaaagatgatatcatttgtcaaaatcctttttttttttttttttttgtgatggagtctcgctctgtcgccaggctggagtgcagtggcatgatcttggctcacggcaacctctgcctccctggcttaagggattctcctgcctcagcctcctgagtagctgggactacaggcgtgcgccaccacgcctagctaatttttgtgtatttttagtagagatcgggtttcaccatgttgcccaggatggtctccatctcttgacctcgtgatccacccgcctcagcctcccaaagtgctgggattaccggtgtgagccaccacgctgggccattaaaatcttatcagtagcttactacatatattcagcccataaatactcccttcaccctgtcgtgttgtcagatgtctaccattttatgtatatattcttctgattgattttttccgttctcttttccattgatgttcattatagcatgatttattcttgatgaaagcattaaagatgagaatgatacgatttgtcccttcccgttctacccttaaggccttgctggtccttatttaattacatcttaagagtcttcttatttttggacttaattcaaaagcctgttattctgatagaggtgacaggtagctagtaagtgtgtttggtggcaaattaaagtatccttggtttttaagctttaccataatgtgcatagataactaagagtttactctaatgctattgattatggtagatgtatttaattgtttgtatcctgtcccaataaggattggagtaatcttgattatattgttcttttgaatatacatatataaaaataatatatttctcattatttattttatttttagcttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 194278 - DNA, 1911 bp, Homo sapiens
  Payload ID: 18389
  Gene Name: transmembrane protein 59
  ENST ID: ENST00000371348
  CDS Start-End: 846-1424
ttctagttatatcaccgttgtgttttttgttgttgttgttttttaagcaacagggtctcactttgtaccccaagctggagtacagtggtgtgattatagctcactgtaccctcaaactcctgggctcaaacaatcctcacacctcagcctactgagtactaggacaacaagtgtgcactaccatacccagttatttttgtgtgtgtgtttgttttggtacagatggggtctcgctatatagtccaggctggcctcaaactgttggcctcaagcagtcctcccacctcagcttcccaaagccctgggattacaggtgtgagccactgcacctggcctgtcactattagttttatttttaatttttcccccccacagattgtaaccaaagaaaatggaaaaagggtggtggttttacctactaggcttttttcttcgtatcacttttaaaataaggaactaaaacctctatatggcaaaggtcttgagtatcaactggctcctatcatttttttctttcagttatgaaacttactggacgatttgtaataaactttactaactgctttcttcctaacctgttttcccctgaggaaaaaaaaatactattttttggtaacccttcctgttcttgaactccctaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataattatgtgctgaaa

SEQ ID NO: 194279 - DNA, 1074 bp, Homo sapiens
  Payload ID: 18389
  Gene Name: transmembrane protein 59
  ENST ID: ENST00000452421
  CDS Start-End: 218-1074
gaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtgtctgccagtttgtacacagtggatcacatagaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgaggtaaattt

SEQ ID NO: 194280 - DNA, 618 bp, Homo sapiens
  Payload ID: 18389
  Gene Name: transmembrane protein 59
  ENST ID: ENST00000440019
  CDS Start-End: 185-618
aggaggccccgcttcgcgctaacgcttgcgatggttgaattcccctcctcacgccagcctaggagaagaagttcgtagtcccagagcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgaggtaaatttaat

SEQ ID NO: 194281 - DNA, 728 bp, Homo sapiens
  Payload ID: 18389
  Gene Name: transmembrane protein 59
  ENST ID: ENST00000420738
  CDS Start-End: 295-728
gatggttgaattcccctcctcacgccagcctaggagaagaagttcgtagtcccagaggtgtctgccagtttgtacacagtggatcacatagaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgaggtaaatttaat

SEQ ID NO: 194282 - DNA, 1613 bp, Homo sapiens
  Payload ID: 18390
  Gene Name: transmembrane protein 59-like
  Uniprot ID: Q9UK28
  ENST ID: ENST00000262817
  CDS Start-End: 88-1116
cagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctatgtcccctctctgcggggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatat

SEQ ID NO: 194283 - DNA, 1717 bp, Homo sapiens
  Payload ID: 18390
  Gene Name: transmembrane protein 59-like
  Uniprot ID: Q9UK28
  ENST ID: ENST00000600490
  CDS Start-End: 186-1214
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctatgtcccctctctgcggggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaaga

SEQ ID NO: 194284 - DNA, 403 bp, Homo sapiens
  Payload ID: 18390
  Gene Name: transmembrane protein 59-like
  ENST ID: ENST00000594709
  CDS Start-End: 1-403
gaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggcgctcgggtctgcctcgctggatcctggcctgctgcctcttcctctccgtgctggtgatgctgtggctgagctgctcca

SEQ ID NO: 194285 - DNA, 1023 bp, Homo sapiens
  Payload ID: 18391
  Gene Name: transmembrane protein 60
  Uniprot ID: Q9H2L4
  ENST ID: ENST00000257663
  CDS Start-End: 378-779
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctca

SEQ ID NO: 194286 - DNA, 1097 bp, Homo sapiens
  Payload ID: 18392
  Gene Name: transmembrane protein 61
  Uniprot ID: Q8N0U2
  ENST ID: ENST00000371268
  CDS Start-End: 275-907
ggcctggctcggtccctgcgcaccgggtgcgggcggcggagagggcgcggctggtgagccctgggagggcccaggagccagacctcggttttgcgggctggggagcagggctcgggggcagcggccaggcccctccgcccctaacacccgcgcctcctgcagacccgagggtcgccgctggtagggtcgctcagccctggcgtcctccaccaccacaccttcacctgcgcccggctccctgcgcgcctggacagcgcctgctgcccgcctcccgatggccctgccccagatgtgtgacgggagccacttggcctccaccctccgctattgcatgacagtcagcggcacagtggttctggtggccgggacgctctgcttcgcttggtggagcgaaggggatgcaaccgcccagcctggccagctggccccacccacggagtatccggtgcctgagggccccagccccctgctcaggtccgtcagcttcgtctgctgcggtgcaggtggcctgctgctgctcattggcctgctgtggtccgtcaaggccagcatcccagggccacctcgatgggacccctatcacctctccagagacctgtactacctcactgtggagtcctcagagaaggagagctgcaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcggagacgacaccgagtgccacacgctcctgctcaggcctggttcagactgcacggggaggaagttaaaggctcctagcaggtcctgaatccagagacaaaaatgccgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgtctca

SEQ ID NO: 194287 - DNA, 2771 bp, Homo sapiens
  Payload ID: 18393
  Gene Name: transmembrane protein 62
  Uniprot ID: Q0P6H9
  ENST ID: ENST00000260403
  CDS Start-End: 280-2211
ggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaaga

SEQ ID NO: 194288 - DNA, 573 bp, Homo sapiens
  Payload ID: 18393
  Gene Name: transmembrane protein 62
  ENST ID: ENST00000569535
  CDS Start-End: 358-480
gtgagccatgatcgcgccactgcattcctgcctgggggatagagaccctgtctgagaagtgaaggaaaggggaatggtagagggaaggggaagagaaagaaaagaaaacctatggaggtacgttaataatcagaaggggccagaggaagccacctgacacatttgtgagacaatttaaaaggcgttctcatacattctcactttgatacaacaaccctgcaaagtgcgcacggaaggtgttattaactccgttttacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaagg

SEQ ID NO: 194289 - DNA, 500 bp, Homo sapiens
  Payload ID: 18393
  Gene Name: transmembrane protein 62
  ENST ID: ENST00000569926
  CDS Start-End: 85-273
ggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatggaaatattctgctgtacgtagagatggctctttccattatgtccacagtactccctttggcaactattcgttcatctgtgtagatgccactgtaaatc

SEQ ID NO: 194290 - DNA, 571 bp, Homo sapiens
  Payload ID: 18393
  Gene Name: transmembrane protein 62
  ENST ID: ENST00000564698
  CDS Start-End: 183-571
aagaagcgctcgcccaggaggaggcagggcaaattggtgaacagggcggcgtgtccttatacgggcacgaactcgcgaggtcctgagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatac

SEQ ID NO: 194291 - DNA, 493 bp, Homo sapiens
  Payload ID: 18393
  Gene Name: transmembrane protein 62
  ENST ID: ENST00000568182
  CDS Start-End: 1-150
gcggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgaaaaagatggaggagctcttattactggccaaggaaagcagtcggagcaaccatacaatttggtttggacactttacaacatccactattctttctccatcaccaggaatccggtcaataatgagggcactttggaacttgaggtgggagactggaaggataataggaggtaccggatttttgcttttgatcacgacctctttagctttgcaga

SEQ ID NO: 194292 - DNA, 356 bp, Homo sapiens
  Payload ID: 18393
  Gene Name: transmembrane protein 62
  ENST ID: ENST00000568197
  CDS Start-End: 1-66
aggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccc

SEQ ID NO: 194293 - DNA, 566 bp, Homo sapiens
  Payload ID: 18393
  Gene Name: transmembrane protein 62
  ENST ID: ENST00000565291
  CDS Start-End: 452-566
actgcattcctgcctgggggatagagaccctgtctgagaagtgaaggaaaggggaatggtagagggaaggggaagagaaagaaaagaaaacctatggaggtacgttaataatcagaaggggccagaggaagccacctgacacatttgtgagacaatttaaaaggcgttctcatacattctcactttgatacaacaaccctgcaaagtgcgcacggaaggtgttattaactccgttttacagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggct

SEQ ID NO: 194294 - DNA, 627 bp, Homo sapiens
  Payload ID: 18393
  Gene Name: transmembrane protein 62
  ENST ID: ENST00000567441
  CDS Start-End: 1-149
cggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactccttt

SEQ ID NO: 194295 - DNA, 2025 bp, Homo sapiens
  Payload ID: 18393
  Gene Name: transmembrane protein 62
  ENST ID: ENST00000564494
  CDS Start-End: 1-1622
ttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaaggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttca

SEQ ID NO: 194296 - DNA, 4098 bp, Homo sapiens
  Payload ID: 18394
  Gene Name: transmembrane protein 63A
  Uniprot ID: O94886
  ENST ID: ENST00000366835
  CDS Start-End: 272-2695
gtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctggacaaagacccgtatagttttgggaggacaacaatagcaaacctacagactgacaatgacctcctttggctgcacaccatctttgctgtcatttacctcttcctcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaa

SEQ ID NO: 194297 - DNA, 454 bp, Homo sapiens
  Payload ID: 18394
  Gene Name: transmembrane protein 63A
  ENST ID: ENST00000436966
  CDS Start-End: 100-454
gcctttggctctgccagcactggtgggaacctgcaagaaatttgagccctgaacgtctgccttgtcctgttgtcctgtgctccagggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactg

SEQ ID NO: 194298 - DNA, 1018 bp, Homo sapiens
  Payload ID: 18394
  Gene Name: transmembrane protein 63A
  ENST ID: ENST00000537914
  CDS Start-End: 638-886
ccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgtctcctgccatgcaaagaaggctcatagagttgctttggaagtggattctttgtacagcctggaagaagacgctgtaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgct

SEQ ID NO: 194299 - DNA, 3318 bp, Homo sapiens
  Payload ID: 18395
  Gene Name: transmembrane protein 63B
  Uniprot ID: Q5T3F8
  ENST ID: ENST00000259746
  CDS Start-End: 184-2682
accacagaggcgtctggctaactcatctccagacctaagttgggaaaggggaggggagcgcggaaagcggagaagccggaggagacgctccggagtgaccagcgacggctgaacgcagcccgccctccccaagtcgacgccgcaacccggggaaagcaggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctga

SEQ ID NO: 194300 - DNA, 3198 bp, Homo sapiens
  Payload ID: 18395
  Gene Name: transmembrane protein 63B
  Uniprot ID: Q5T3F8
  ENST ID: ENST00000323267
  CDS Start-End: 65-2563
aacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctg

SEQ ID NO: 194301 - DNA, 2921 bp, Homo sapiens
  Payload ID: 18395
  Gene Name: transmembrane protein 63B
  ENST ID: ENST00000371893
  CDS Start-End: 1-2285
tctctatcctccggaaggtggcctgggactatgggcggctggccttggtgacagatgcagacagtgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctga

SEQ ID NO: 194302 - DNA, 2465 bp, Homo sapiens
  Payload ID: 18395
  Gene Name: transmembrane protein 63B
  ENST ID: ENST00000533121
  CDS Start-End: 1-1561
caatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctga

SEQ ID NO: 194303 - DNA, 616 bp, Homo sapiens
  Payload ID: 18395
  Gene Name: transmembrane protein 63B
  ENST ID: ENST00000497371
  CDS Start-End: 1-83
cctctgtctccagctccgttgactttgaccaaagggacaatggtttctgttcctggctgacagccatcttcaggataaagtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcag

SEQ ID NO: 194304 - DNA, 828 bp, Homo sapiens
  Payload ID: 18395
  Gene Name: transmembrane protein 63B
  ENST ID: ENST00000532634
  CDS Start-End: 150-828
atacactgccgcggccgccgcaggagcccggagctcgagccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacaca

SEQ ID NO: 194305 - DNA, 5334 bp, Homo sapiens
  Payload ID: 18396
  Gene Name: transmembrane protein 63C
  Uniprot ID: Q9P1W3
  ENST ID: ENST00000298351
  CDS Start-End: 145-2565
ctgtcactgcagcctggcggcctgagcgccgagcctggggctggggccgcggtgctgaggacgcaaatcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacagcctgacctcgctgatctatggggagcagagcgagaagacatctccctcggagacttccttggagatggaacgcagagacaagggattctgttcctggttcttcaacagcataacaatgaaggacgaggatctgattaacaagtgtggggacgacgcgcgcatctacatcgtgttccagtaccacctcatcatctttgtgctcatcatctgtatcccctccctgggcatcattttgcccatcaactatactggatctgttctggactggagcagtcactttgctcggaccaccattgtcaatgtctccacagagagcaagctcctgtggctgcatagcctgctgtccttcttctacttcatcaccaacttcatgttcatggctcatcactgcctggggtttgcacccaggaatagccaaaaggtcacaaggacactaatgatcacctatgtgcccaaggacattgaagacccagaactcatcattaagcattttcacgaggcctatccaggcagtgtcgtgacaagagtccacttctgctacgacgtcaggaacctgatcgacttggacgatcagaggcgccatgccatgcggggccggcttttctatacagccaaggccaagaagactgggaaggtgatgatcaggatccacccctgtgcccgcctgtgcttctgcaagtgctggacctgcttcaaggaggtggatgcagagcagtattacagcgagctagaggagcagctaacggacgagttcaacgccgagctcaaccgcgtgccgctcaagcggctggacctgatctttgtcaccttccaggactccaggatggccaagcgtgtccgtaaggattacaagtatgtccagtgtggtgtgcaaccccagcagtcctcagtgaccaccatcgtcaaatcatattactggagggtcactatggccccacaccccaaagacattatttggaaacacctgtctgtccgccgcttcttttggtgggcccgctttatcgcaatcaacaccttcctcttcttcctcttcttctttctcaccacgcctgccatcatcatgaacactatcgacatgtacaacgtcacccgccccatcgagaagctgcagaacccaattgtgacccagttcttcccctctgtgatgctctggggcttcacagtgatactgcctctgattgtctacttctccgccttcctcgaggcccactggaccagatcaagtcagaatctggtcatggtgcacaagtgctacatctttctggtgttcatggtagtcattctgccctctatgggactgaccagtttggatgtctttctccgctggctctttgacatctactatctagagcaagcatccatcaggttccagtgtgtgttcctgccagacaacggcgccttctttgtcaactacgtgatcacggcagctttacttggcacaggcatggagctgctgcgtctggggtcactcttctgctacagcacccgcctcttcttctctagatcagagccagagagagtcaacatcagaaagaaccaggccatagacttccagtttgggcgtgagtatgcgtggatgatgaacgtgttcagcgtggtgatggcgtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactgggggtgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttccaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaactctgtgtggtgggaaaccagctatacctccccaagccccagggcctaaagagaagacccccgaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctc

SEQ ID NO: 194306 - DNA, 582 bp, Homo sapiens
  Payload ID: 18396
  Gene Name: transmembrane protein 63C
  ENST ID: ENST00000557408
  CDS Start-End: 512-582
agtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttcca

SEQ ID NO: 194307 - DNA, 457 bp, Homo sapiens
  Payload ID: 18396
  Gene Name: transmembrane protein 63C
  ENST ID: ENST00000554346
  CDS Start-End: 308-457
ctgtcactgcagcctggcggcctgagcgccgagcctggggctggggccgcggtgctgaggacgcaaatgtgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtg

SEQ ID NO: 194308 - DNA, 515 bp, Homo sapiens
  Payload ID: 18396
  Gene Name: transmembrane protein 63C
  ENST ID: ENST00000555338
  CDS Start-End: 362-515
aatatcattcagtgatagtggcggtggataacaatgacctcctaccagctgtgaatttctcgtcttccactagtactagtaaaagagattgctgctggctaagaatacccaccggtggggtcttgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcg

SEQ ID NO: 194309 - DNA, 527 bp, Homo sapiens
  Payload ID: 18396
  Gene Name: transmembrane protein 63C
  ENST ID: ENST00000556514
  CDS Start-End: 419-527
atcattcagtgatagtggcggtggataacaatgacctcctaccagctgtgaatttctcgtcttccactagtactagtaaaagagattgctgctggctaagaatacccaccggtggggtcttgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagatatgggaactgaggctgagacagatgaagtcactgcccctggtcacacagctagcaaagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggg

SEQ ID NO: 194310 - DNA, 1004 bp, Homo sapiens
  Payload ID: 18396
  Gene Name: transmembrane protein 63C
  ENST ID: ENST00000554766
  CDS Start-End: 512-1004
tgccagcctgggttccccggcaggtcagagaagctttggggcggggccaaggttggcccctgcttgggaggagccgggatgcctctctcacagtgatgcagagaggaatttgctgacagtcccttgccaggtggggctggcttcgcccagccggcgaggaggaggacccgctggcagtctcctcccaggtggggagcgtggagcctgtcactgcagcctggcggcctgagcgccgagcctggggctggggccgcggtgctgaggacgcaaatgtgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacagcctgacctcgctgatctatggggagcagagcgagaagacatctccctcggagacttccttggagatggaacgcagagacaagggattctgttcctggttcttcaacagcataacaatgaaggacgaggatctgattaacaagtgtggggacgacgcgcgcatctacatcgtgttccagtaccacctcatcatctttgtgctcatcatctgtatcccctccctgggcatcattttgcccatcaactatactggatctgttctgg

SEQ ID NO: 194311 - DNA, 1174 bp, Homo sapiens
  Payload ID: 18397
  Gene Name: transmembrane protein 64
  ENST ID: ENST00000422900
  CDS Start-End: 1-594
ctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacaggg

SEQ ID NO: 194312 - DNA, 4663 bp, Homo sapiens
  Payload ID: 18397
  Gene Name: transmembrane protein 64
  Uniprot ID: Q6YI46
  ENST ID: ENST00000418210
  CDS Start-End: 1-987
atgcggagcccgggcgggatcctgctccaggcgctgccccggctgctgcagcacgccgccctcccgggcctcgccgagctgccggcccgctgggccctgccgcggggtgcgggcggggacggcccggcggaccgccttccccgcgggggcggggcgagcgcggcggcggcagcagcggcggcctcgggcgccctgctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttc

SEQ ID NO: 194313 - DNA, 4997 bp, Homo sapiens
  Payload ID: 18397
  Gene Name: transmembrane protein 64
  Uniprot ID: Q6YI46
  ENST ID: ENST00000458549
  CDS Start-End: 179-1321
actccccgcctggccgtcgctcctccgctgactccgcgcccttctacgggccgtctcccaccctctgagcggacgcagggagtcgatgccgggcgaaccgggcgccatgaagggcagctgcctaacgggcgccgcggcggaggggctggccggctgagggcccgcgctgggccgaggcatgcggagcccgggcgggatcctgctccaggcgctgccccggctgctgcagcacgccgccctcccgggcctcgccgagctgccggcccgctgggccctgccgcggggtgcgggcggggacggcccggcggaccgccttccccgcgggggcggggcgagcgcggcggcggcagcagcggcggcctcgggcgccctgctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctacccagcttctgaattcttacttgggtaccaccctgcggacaatggaagatgtcattgcagaacagagtgttagtggatattttgttttttgtttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttc

SEQ ID NO: 194314 - DNA, 873 bp, Homo sapiens
  Payload ID: 18397
  Gene Name: transmembrane protein 64
  Uniprot ID: Q6YI46
  ENST ID: ENST00000519519
  CDS Start-End: 514-873
tgtcatccccgcacgtagcaacgcgcggaggggagcgggctctgcccccggcacggccatcggccacggctggagatagcctggggacccctaccagccccacgacggccccaagtgcagggatggaggagggcgtccggacagagagaagggacgaatggcagggcgtttgtcctgagcagccaaagcgcaagctatctcagctcagttcagaacccttgctggagaggtggtgcagtcatttggaggaaagaagaactctggctttttgaattaattcatgaaagctgagcaaattaaagatgagtctttaaagataacacaaaaagttcccagccaagatggacgaataggaacaactctggtctgcagttcccagtgagaccaatgcagaaggaggaggatgaagctcagaaagttcagttgacctgagaaaagtcacacagacagtgactagcaaaactgcaagcggactaatacttacctgattcgaagtctcctgatggttttgctatgcctccacgtattactgatctctcattacccaactatctgatggcatcttcggttggactgcttcctacccagcttctgaattcttacttgggtaccaccctgcggacaatggaagatgtcattgcagaacagagtgttagtggatattttgttttttgtttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatga

SEQ ID NO: 194315 - DNA, 587 bp, Homo sapiens
  Payload ID: 18397
  Gene Name: transmembrane protein 64
  ENST ID: ENST00000521852
  CDS Start-End: 434-587
atgtcatccccgcacgtagcaacgcgcggaggggagcgggctctgcccccggcacggccatcggccacggctggagatagcctggggacccctaccagccccacgacggccccaagtgcagggatggaggagggcgtccggacagagagaagggacgaatggcagggcgtttgtcctgagcagccaaagcgcaagaattcatgaaagctgagcaaattaaagatgagtctttaaagataacacaaaaagttcccagccaagatggacgaataggaacaactctggtctgcagttcccagtgagaccaatgcagaaggaggaggatgaagctcagaaagttcagttgacctgagaaaagtcacacagacagtgactagcaaaactgcaagcggactaatacttacctgattcgaagtctcctgatggttttgctatgcctccacgtattactgatctctcattacccaactatctgatggcatcttcggttggactgcttcctacccagcttctgaattcttacttgggtaccaccctgcggacaatggaagatgtcattgcagaacagagtgttagtggatattttg

SEQ ID NO: 194316 - DNA, 9029 bp, Homo sapiens
  Payload ID: 18398
  Gene Name: transmembrane protein 65
  Uniprot ID: Q6PI78
  ENST ID: ENST00000297632
  CDS Start-End: 536-1258
gccgctaggggtagcggcggcggcggcggctgcggctcgggagcgcggctgctttgagggctcgggaaccttacagagtggggacgtggggaggctagagggtgagaaagctggcgggagagtagggcggcgctggaggagggcggtgcgtggctgactcatcctctggaagatcagactgacagagacacacactagcccgccccgcccgcccgcgccgctcctcctcagccgggaggcgcccgcccgcaccgaccgcccgccctctccgggcgctgtccgggcccggccgtctcagagaaagtttttcccatcggaggggcgggagccgccgcgggccttttggaaaggaagtggggacggaacaggaggcgagagccgcgcgggcccgcggagtgcatggtgcccggcgcctcggctgcctggcaggaggacctcggggcggggtcgagctgagcccagctccttctcgcctcagccgcgccagaaaccgccttgccggacggccgcgggggtcccagctcctcagctcgccatgtcccggctgctgccgctgctgaggagccggaccgcgcgcagcctgaggccgggcccggccgccgccgccgcgccccgcccgccgtcctggtgctgctgcgggcgggggctgctggcgctcgcgccccccggcggcttgccgggcggccccaggcggctgggcacgcaccccaagaaggagcccatggaggcgctgaacacggcgcagggcgcgcgcgacttcatctacagcctgcactccacggagaggagctgcctgctcaaagagctgcaccgcttcgagtctattgccattgcccaagaaaaattggaagctccaccacccaccccaggacagctgagatatgtattcatccacaatgcgatacctttcatagggtttggctttttggataatgcaattatgattgttgctggaacccatattgaaatgtctattggaattattttgggaatttcaactatggcagctgctgctttgggaaatcttgtgtcagatctagctggacttggacttgcaggctacgttgaagcattggcttccaggttaggcctgtcaattcctgatctcacaccaaagcaagttgacatgtggcaaacacgtcttagtacacatttgggcaaagctgttggggtgactattggctgcattctaggaatgtttcctttaattttctttggaggaggtgaagaagatgaaaaactggaaacgaaaagttaatcctcttagaatacctataaaaagatgtaaactaatgtacctcagtaattaaatatgctgtcacaacatttaggaattaagacagtaacagtatagatatgggatcaaataatttagcatgtattatggaaaacactaacttattgtggcttgatcttcttaggacatcttttttaaaaagctgtttagtatcattttgtgtatattgttgaaatgctttttcatcaatagcagtcaacattttatcctttctttttatattcataatgttatttaagtgtcattgatgtactgtattgacttggggtttgcttatttgttacttaacatgtgtacatgcatgaaagcatttttcgttgttccctgatagttacatttcaaccttgggatttttccaaattacttaagatgtttaatgtcagttaaagatttttttaccctctttttgggaacatcaattttgtactgttatgcagtaaacatttataataatataatttcagtcatttcttaactgtcacatctattgaaaatggatatagatacaggttttaagtattttaagtatatattacttattttaattttctgactttactattttaagggccagagggttaatcacaaagagcaattatgtggtctccctgctacatgaaaccgtgtatactaacaagcgtacaatttttagttgattttttttaaccttttagtttcccagttttgaataattacatggtggattctgacttttgaggggaagcaaatgattattttagagtctttgaaatggggattgtggaattagattgaactaagggatttaacatgatgcttggaaattaagagactaaagctttttttaaaaaaaggtggaaaataggaactgtcaagaaggtttatggtataaatgatgaagttgaagtgatgtttgaaagattaatgagatacaatttatattatttggtaaggtttttttttttccctccaaagatgtcatcttctcatctgaatggaataagtctgaataccccatattcatactcctaatctcattatatcttatttagtgaattttatttatgaataatttctgttgaagtgaaaactagatatttaatattttgcttttttgctacatagtctactcaaaaattacatgaggagaaatcctttttccctttgtttttcttttttcttcttttgtggtatttaaagcatattttaggttgaagttacttatttctagtcttgtacttctggcttaagtataaccatgtaagaattataaattttagttttctgaacccttaaacttttttagcatgtggtctgttacacatgctaaaaaattagtcttacttgtaacagcgtaattaaacacatcatggaggagagaaacttaaaattaaaatagtattttggcttttgaagttatttgtgttgctaaatagatgcagaggttttacagcagtttattttaaggttttatttatacataattactttgaactcttcagagtagatattttttcacaaggcagtttgtcataaattctctcatgcgcttcagaatgcataagtgccatcctttaatcatagactttgaggagagaaagcataaaaatatagcatataatctaaaaataaatatataacatgcacaaataatgtgacattcttactgaatcaaatcatgattctagaacttgagatcttaaatagaatttcggtttgtatcttccatataataaccacacacagataaccacacaaaaaatcctttgtaaaatttctgattgataggattagagtgcttaaatttttggggggggaagggtggggtaaagtgtaagtgctttcttttgtccctaacttgtgtattgatggcagtccactctgttttctaaaaatgtattttactgtggtgcttaacttcttattaattaaatcccgtatcagaaaccttgcctgtgactttagaaagggcttttgattattgttttttcttcttgctcttgaaagtaatctggtcccagggaattactggtttaactgaacatctccagaattatttaaggtgtcaaaatatataaccttcacattgaaagataattttaatttatgggcataataaaaatttgaatcattcaggtaattttcaaaaaatggagaccatttgtctttaactgaaggtatatgtttaagatcatagtctaccctagtatggtgctttgccacaaagtgatttctgaagaatggttctttttaagataatgacttcatatgatcattgtttcatgttacttgccacaaataactttaatttaggttgaaactggaactgtttgtttctcatattagctacttctctattaggagcacaagaaccatagttaaatgcaacatgagctactttagtcctgtttgtttaaatttgtgttgtccatgtattatgatttattaacttgttgatgcatgtaaattgggtgcattttgttgccatgtatgttaaatggtgaccaatgtttttacaaaggaattgaacaaaaaaagtatcttttaagaaatttggaatgtggttttgattttgaaatttgatttcttactaatctcagagggccttggtatattctgttactaaagcaaacaggattaatgaatacggatttgttacaaggtggcagcaatgtcactgagatagtgaatggaacaatttaccacctccctggaatctgcacctgagatacaacatcagcgtatgagtgaagagtgagcccatagaaaagctttagatagactcacataagtcacactgatgggtatttacagcagatatatccaagctgtttatgtaatagtctcatttactttattctttttctctagaacataaattttgaaggtaatggaagtttatcttttataccaaaagtttgtatgagccattttgaagtaaatctttctaattttagaattatattttctcgccatcttaagacagtatattaaatataatataacctttttcttagtggctaagcattatctttatgtatattattattgtgtggtaatgcagtaccttgagaatctagtttttatagttttcatttttttttctgatcttgcttctggcaacttttatctctctaatctgctttttttctcagttgtctggacttagaaactggttagcctatcttaccataaattatttgggaaatactaaaaaattggctttggatcctgactgagatgatgatgatgatagtagtagtagtaataataatagttcccttttattaaacacttatttggtcctttatgcactagtaatttacacacattattgcatttaatcaccttaatgacaacattaagttggggctattatcattatcatctctattttctcatagctaaattgaggcatgaagaggttagtttgccactacgaataagtggactggaatcctattttgtccaagtatgaagcctgtcttcttaactgctaggcagtagggacatcagttgcatgggctttgcaatgtctgctctctgcctaggttcctttttacctccagattcatggagtcattttcttatctataatttaagaatattgtgcttacaatccaagattcatttaagaaatcttgtgttctttattacatactatgtgctaggatgttcaaggcactgagtgaacaaccagaacatctgtaccctcatgaagcttattcttttggggtgggtagtaataggggaagagaacacagaaaagcaaatatacttttttttgagatggagtcttgatgtcacccaggctggagtgcagtggcgtgatcttggcttattgcaacctctgcttcctgggttcaagtgattctcctgcctcagcctcctgagtagctgggattacagtcacgtgccaccgagcctaatttttttgtatttttagtagaaacggggtttcaccatgttggccaggctggcctcagactcctgacctcctgagtagctgggattacaggcacgtgccaccgagcctaatttttttgtatttttagtagaaacggggtttcaccatgttggccaggctggcctcagactcctgacctcaggtggtccacctgtctcggcctcccaaagtgctgggattacaggcgtgagcccctgcgcccacctgcaaatatacacttaaatattgtttatgtcagatggtggtaagttctatagagataaatgaaacaagataaagaggatagaaagtaccagtggtcataagtgaagatggtcagtgaagacctgaaggaagcgaaggtacaaacagtacagatattctgtgaagagaaagtatcatgctaggtactagaaagttggtgttaagaaaatctcagatatgtgaaatatgtttcactttggaattcattgtaaaatgttttctttttgtttcatattactaataactgcattaagcctaaagagtaacagttaaatattaagattaatacttacttcttgcatgtttactgacagcagtaggtgaaaatggcacagaagtgtggggaagcaaccctagaattcaaaaaagtctgtagatattcccatcagcaaatcatttacagttgactcttgaacaatggagggattagggacaccaaccccctgtgctgctgaaaatctgaatacaactttttactctctccaaactttacttatagcctcctattggctggaagcctttctgataaataagcagtagattaacacgtattttgtatgttatatgtatcatatattgtattaaaataaaggtagaagaaagaaaatgttattaaaatcatcaggaagagaaaatacatttactattcattaagtggatcatgataaaagtcttcatcctccttgtcttcatgttgagtaggctgaggtggaggaggaagaggaaggattggtcttgctcttagtggtagcagaggtgcaaggggaagcaggaaaggcaggcacactacgtgtaattatgaaaatgcattgtaacttctgtctgatgttttgctttttttcatttctcaaaatatttctatatatggtattaatccttcttccaccatttgctttagttttagtgcctgtgtgatagaagggttcatgttgtaaaatcagtcttgaataatcagaacacttctaccagattgtctaatgttgatttgttttctggcactgcttctaaatgtcttcctcctcattctgtggcactgattcagaggcactcatctccaaaagctaagcttttgaattgcttagcttttgattcactccaggattcagatcttgaaactttctaccctccaccatttatttatttatttaatttgacatatctacaacctctttcatgattttcttgattggctctgttgtaaattctgcgaagtcacacacaacatctggttgttttcctcagcaggaatttattgttttgggcttgatggctttcatgtcttctgtagcaacaatggcatcatcagtggtggaatccttccagactttgatgatgttctctttgttagagttctcttgcatggcactgatggttctttgcatagagtactgtgtgtaatgagcctataggtccttatgactccctgatctagaaactaaattagagacattgtgtttgggggcaaatagatcacttcgatgcctttagtattgaactcatggagttctgggtgggtggccaggggcattgtccagtatcaaaacaactttaaaaggcagtcctttactggcaaggtacttcctgacttcaaagacaaaacagcaatggagccaatccagaaaaagggttcttgtcgtccaggccttcttgttatactgccagaagactggcagctggtgtttatcttttcccttcaagacttgggagttaacagctttatagataagtgcagtcttgatcataaacccaacagcatttgcaaaaacccatagcattagcctgtccctttctgccttaaaccctggtgctcacttctcttctttactaataaatgttctttgtggcatattattatttttccataatagggcacttctgtctgccttaagaacctgttttggtagatatgctttctcctcaatgattttcttaatggcatctgggaactcatttgctgcctcttggtcatcaggagctgcctcttctgttatcttaacatttttaaagccaaacttctttctaatattatcaagccatcctttgctggcattaaattctctagatttagatccttcaccttccttttgctttaaattgtcatataatgaccgccttttctccaatcatattagagcctataggtacgtctttcttgtagcaatactgcacccacataaaagttgcatttttaatacgagataaaaaggtatatcacaaaaagtgtaaggtttgctggtatagatgcagtaatggcttcataaattttcttaattttttttaacagtggtccttatgctggattcatttatcttgaaggatgggcaactacagctgcagaccagtacacatcaagcaatttaactttttcttgtaatgtcatgactttgctccttgggagcacttccagcgtcactagcgggacttcatatgggtcccttggtattattgcaaggtttatggttgtactaaacatgatgaaaaataactgagaaccatgagagatcactttttactacgatacacaatttactggagagatgaactgcccatgtggagatgataaacatcacatggcattttaagtgaatacagcacttgagctcacagcaacagcaacaggaggtagctctgaaattatggtagtagtgcagtatgtactatagttaatcttatccagttgtaatttagtactgcatctttatgtttgtctcaactgcaaatggctccaatgtatagtctgtgtatgcgttaagttttgataaattttaactttttttttttttgagatggagtcttgctctgttgtccaggctggagtgcagtggcaccatgccggctcactgcaacctctgtcttctgggttcaagtgattctcctgcctcagcctcccaagtagttgggattacaggcatgcatccccatgcccagctaatttttgtatttttaggagaaacagggtttcaccatgttggccaggctgctcttgaactcctgacctcaggtgatccgcctgcctcggcctcctgaagtgttgggattacaggcgtgagccactgcgcccggccaattttaacttttcataatagatttgtatatatttatggtagtaaatgataaaatagactagtgtctacatatattatatgaattcatgacacacctttttcttagtttttcagtatttctaagctacatggtgcatctgcaagttttttaaattgttgcaaatttccaaaaaaattttcaatatatttatcaaaatatgcatataagcggtcctatgcagttcaaacccgtgtttgagaatcaactttatgacttccagtgtcattctccaccatttctgcagtttatcacattttgcttcaggcagatttggtaaatcttcaatgatagttctctaggccattgttttgtaacatgatcaaatgcttaatgggaaatagaatatgtatatgtattctttgtctaccaactaccaaagaaacaaatactcctcagtttgacttgacttagtaaataaacttgtgttgggttaatgga

SEQ ID NO: 194317 - DNA, 3284 bp, Homo sapiens
  Payload ID: 18399
  Gene Name: transmembrane protein 67
  ENST ID: ENST00000323130
  CDS Start-End: 19-2976
ggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccaattcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtcctcttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcagagacaagggttcaccatgttgcccaggctagtcttgaactcctgatcgagagattcacccacctcggcctccaaaagtgctgggattacaggtgtcagccactacacatggccaggattagtttcttagaatgtgcttttaacattgagtaaactatgaatgctggaatttttatttttagtttaaaatatctgccccaaaatatatttttttcttgctaataaattaataatatgatattaaaa

SEQ ID NO: 194318 - DNA, 3255 bp, Homo sapiens
  Payload ID: 18399
  Gene Name: transmembrane protein 67
  Uniprot ID: Q5HYA8
  ENST ID: ENST00000409623
  CDS Start-End: 203-2947
aggctgtgaggcttccagcgtcggcccagaccttctctttccctttccagcagccggagaagtgcgacaacaaccagtactttgatatctccgccctctcgtgtgttccttgtggagctaaccagaggcaagatgcccgaggtgttacagaagatggctggaactgcatttcttgccctagtgacttaactgccgaaggaaaatgtcactgtcccattggccatattttaggctggtcttgaacttccgacctcaggtgatctgcctgcctcagcctcccaaagtgctgggatacaggcttgagccaccgcacctgaccttggcatgtactttagaaggaatgtacaacataattgaagaaattttggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccaattcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtcctcttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatc

SEQ ID NO: 194319 - DNA, 1461 bp, Homo sapiens
  Payload ID: 18399
  Gene Name: transmembrane protein 67
  ENST ID: ENST00000452276
  CDS Start-End: 271-1461
aatcagctcagcgaagccgccgcagaggctgatggggggctggaggctgtgaggcttccagcgtcggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgcc

SEQ ID NO: 194320 - DNA, 4651 bp, Homo sapiens
  Payload ID: 18399
  Gene Name: transmembrane protein 67
  Uniprot ID: Q5HYA8
  ENST ID: ENST00000453321
  CDS Start-End: 59-3046
aagccgccgcagaggctgatggggggctggaggctgtgaggcttccagcgtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgtagaatttcagctgcacgttatggagaagttggcatgtctttaacttcagaatggtttgcaaagtatttgcaatcatcagcagctgcatgttgggtatatgccaatctaacatcttgtcaagctcttggaaatatgtgtgtgatgaacatgaattcttacgactttgccacatttgatgcatgtggactatttcagtttatctttgaaaatactgctggactgagcactgttcattctatttcattttggagacagaatcttccttggctgttttatggagaccagttaggattagcacctcaagtgctcagttctacctctcttcctacaaatttcagttttaaaggagaaaaccagaatacaaaactgaagtttgttgctgcttcctatgatataagaggaaattttctcaagtggcaaactttagaaggaggtgttttacagctttgtccagacacagagacaaggctaaatgctgcttattcatttggaacaacctaccaacaaaattgtgagattcctatctctaagatcttaattgactttcccactcctatattttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttcaaagcacagaagtctgtgtctgttttgctgccaatgccaattcaggaagaacgttttgtcacttatgttggatgtgcctttgctctgaaggcactacaatttttgcataagctcatatcccagattacaatagatgtattctttattgattgggagcgacctaaaggaaaggttcttaaagctgttgaaggtgagggtggtgtacgaagtgccactgttcctgtaagcatatggagaacatattttgtagcaaatgaatggaatgaaattcagactgtgagaaaaattaattcactctttcaagtacttactgtcctcttctttttggaggttgtgggattcaagaacttagcattaatggactcatcttctagtctttctagaaacccacctagctacatagctccttatagctgcattttgagatatgcagtgtctgctgctctttggctagccattggaattatacaggtcgtgttctttgctgtcttttatgagagatttatagaagataaaattcgacagttcgttgatttatgctctatgagtaatatatcagtgtttctgttatcccacaaatgttttggatattacattcatggtagatcagtacatgggcatgcagatactaatatggaagaaatgaatatgaaccttaaaagagaagcggaaaatttgtgtagccagagaggtttggtacccaacacagatggtcagacttttgagattgcaatttctaaccagatgagacaacattatgacagaattcatgagacactaataaggaaaaatggtcctgctagactactgagttcatcagcaagtacttttgagcagagtataaaagcatatcatatgatgaataaatttcttggctccttcattgaccatgttcataaggaaatggattactttataaaagataagttgcttcttgaaagaattcttggaatggaattcatggaaccaatggaaaaaagcatcttttacaatgatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatttaacttcctgaataaataacttaaagactcagtataatcatggccaaaaaaaagtcatgatatcaggttagtttgccatattttttaaaacttataatgcagactattctgtttttgttttttatttgcagaaagatttatttttataacttgggaatatataacctgatataatagaaaatactgttttcccattgtgtgtagtatttaatgcagtaaataataaattaatactgacagtgaggccaaaaaaaatctaaatgttgctttcagcataatactttttaatgctaattaaaacagtccccatcatttgtctctgtagattattttataaactgagagctgcctgaatcttctcacattgacaaagtaatttgattccaagtttaagactagttttcagtttgatattttcatgttttgtgtgcttatggttaaataaatgttgaaagatattttcaagtttacttagaaattttaaattgtattattgctgattcaatttgcatcattctaattgctcatcctctttggcagtggattaattcactgttgggttaatatgcatctcatgaaatgatatcttttcattcctttgtatacctgtattaggtcagtatacgctttccatgaaatatatttgcatttctaatatagtttacatttattaagttataacgtatgacatttttcccaatatcattttttatacattttaattacttaatgttttaagagttctcttccagagttttgcttttcaattacgtttaaagactgtaaataacaaacagtaaggctgggcgctgtggcttacgcctgtaatcccagcactttggaaggccaaggcacgtggatcactttaggtcaggagttcaagaacagcctggccaacatggaaaaccccatctctacaaaaaatacaaaaattagttggatgtggtggcctgtaatcccagctatttgggaggctgaggcatgagaatagcttgaaaccaggaggtggaggctgtagtgagccagatagcaccactgcactccagccaggatgacagagcaagaccctgtctcagaaaaaacaaaaacaaaacactgtaaatgtatcatgtttctcactgctttctatgttaatgctgtgtaaatacttaaaatggaatactgtataaatattatttatattttctcagatgaaaatatatactaaaacatttggtatttctgttttctgtttcattaatgtatatctgatggagtaccatttaggaatataacattattggggcagaggtcccagccattgccaaagttgaatcttttacatttccctgaatcttgaggatgactgaaaaggaagtctttgaaactgcagtttctgaaggatcacagtacaggaatgcctttataaaagctgcagagataaatacatgtacttatatggcatggatatttaaaaccactcactcagaagcatatgaaagaaattcaaccatcattcaacatagaagaagttaattttagtgcaaaagtttttaagtattaaatttcacaataaaggatcaattggcttacttgctgataaattaaaacagaaaacatttaaaatca

SEQ ID NO: 194321 - DNA, 561 bp, Homo sapiens
  Payload ID: 18399
  Gene Name: transmembrane protein 67
  ENST ID: ENST00000453906
  CDS Start-End: 21-561
aggcttccagcgtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagacagcaactctggaaagtggcttctaactcggcgcattttcttagtggatgcagtaagtggacgagaaaatgacttaggaactcagccaagagtaattcgagttgctactcaaatatcactgagtgtccaccttg

SEQ ID NO: 194322 - DNA, 743 bp, Homo sapiens
  Payload ID: 18399
  Gene Name: transmembrane protein 67
  ENST ID: ENST00000455946
  CDS Start-End: 7-450
ggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagggtctcactcttgcccaggctggagtgtagtggtgtgatctcagctcactgcaacctccacctaccaggttcaagtgattctcatgcctcagacacttgagtagctgggattacagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcagcagcacagggaattttcctctacgt

SEQ ID NO: 194323 - DNA, 492 bp, Homo sapiens
  Payload ID: 18399
  Gene Name: transmembrane protein 67
  ENST ID: ENST00000521065
  CDS Start-End: 1-262
gacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgagaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggat

SEQ ID NO: 194324 - DNA, 715 bp, Homo sapiens
  Payload ID: 18399
  Gene Name: transmembrane protein 67
  ENST ID: ENST00000520680
  CDS Start-End: 1-715
attttatgatgtgtaccttgaatatactgatgaaaatcaacatcaatatattttggctgtgcctgtgttaaacctaaatcttcaacataataagatatttgtgaaccaagacagcaactctggaaagtggcttctaactcggcgcattttcttagtggatgcagtaagtggacgagaaaatgacttaggaactcagccaagagtaattcgagttgctactcaaatatcactgagtgtccaccttgtacccaacacaataaatggaaacatctaccctcccttaatcaccattgcctacagtgacattgatatcaaagatgccaacagccagtctgtgaaggtttctttctcagtcacatatgaaatggatcatggagaagcacatgtccagacagatacggagttttgcacttgttgcccaggctggagtgcaatggcacgatcttggctcaccgcaacctctgcctcccgggttcaagcgattctcctgtctcagcctcctgaatatctgggattacagattgctttgggtgtattgggtgggctagctgttttagcatctcttttgaagacagcaggatggaagaggcgcattgggagtcccatgattgatttacagacagttgtgaaattcttggtgtactatgctggtgatctggccaatgttttctttatcatcacagtgggaacaggtctttactggcttattttcttc

SEQ ID NO: 194325 - DNA, 564 bp, Homo sapiens
  Payload ID: 18399
  Gene Name: transmembrane protein 67
  ENST ID: ENST00000521222
  CDS Start-End: 10-369
gtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgtt

SEQ ID NO: 194326 - DNA, 480 bp, Homo sapiens
  Payload ID: 18399
  Gene Name: transmembrane protein 67
  ENST ID: ENST00000498673
  CDS Start-End: 463-480
gcagaggctgatggggggctggaggctgtgaggcttccagcgtcggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatggtgcgcataatttattttaaaataacttacctgtaaaaagtaaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgcttta

SEQ ID NO: 194327 - DNA, 571 bp, Homo sapiens
  Payload ID: 18399
  Gene Name: transmembrane protein 67
  ENST ID: ENST00000518319
  CDS Start-End: 456-571
gcagaggctgatggggggctggaggctgtgaggcttccagcgtcggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatggtgttacagaagatggctggaactgcatttcttgccctagtgacttaactgccgaaggaaaatgtcactgtcccattggccatattttagtgtttcacgcctgtaatcgcagcactttgggaagccgagtggaaagagacattaatggaacattgttgtctcaagcaacttgtgagctctgtgatggaaatgaaaactcttttatggtagtaaatgctttaggagacaggtgcgtccgatgtgagccaacatttgttaataccagcaggtcctgtgcatgttcagaacctaacattttaacagggggattatgtttcag

SEQ ID NO: 194328 - DNA, 518 bp, Homo sapiens
  Payload ID: 18399
  Gene Name: transmembrane protein 67
  ENST ID: ENST00000521517
  CDS Start-End: 1-518
gcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttagtggaaagagacattaatggaacattgttgtctcaagcaacttgtgagctctgtgatggaaatgaaaactcttttatggtagtaaatgctttaggagacagacagggggattatgtttcag

SEQ ID NO: 194329 - DNA, 2401 bp, Homo sapiens
  Payload ID: 18400
  Gene Name: transmembrane protein 68
  Uniprot ID: Q96MH6
  ENST ID: ENST00000334667
  CDS Start-End: 254-1027
ggtgtcacccccatcgcggcccgggctgcagccgccgcttggcttctttcacacgggttgcttcggaggaatccgccgtgcaaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaa

SEQ ID NO: 194330 - DNA, 2549 bp, Homo sapiens
  Payload ID: 18400
  Gene Name: transmembrane protein 68
  Uniprot ID: Q96MH6
  ENST ID: ENST00000434581
  CDS Start-End: 201-1175
cgggttgcttcggaggaatccgccgtgcaaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaa

SEQ ID NO: 194331 - DNA, 510 bp, Homo sapiens
  Payload ID: 18400
  Gene Name: transmembrane protein 68
  ENST ID: ENST00000523180
  CDS Start-End: 505-510
agccgccgcttggcttctttcacacgggttgcttcggaggaatccgccgtgcaaatctgtccgcccccttggccactgatcccccgaagagcttctgtcgccgctctaggaatagagacattgaagtttgggacaagatatttatctaacttctgagttatctcaatatggctgggcatggtggctgatgcctgtaatctcagcactttgggaggctgaggtgggtggaccacttgaggtcaggagtttgggaccagcctggccaacatagtgaaaccctgtctctactaaaaatacaaaaattagccaggcatggtggcacatgcctgtagtcccagctgctcgggatgctgaggcaggaggattacctgaacctgggaggcagaggtttcagtgactgagatcgtgccactgtactccagcccgagcaaaaggtgtcaaaattagcgacctgctatggcaatgaagaaagaaactgaatttgtcattttcacctgaagaaaaatgata

SEQ ID NO: 194332 - DNA, 659 bp, Homo sapiens
  Payload ID: 18400
  Gene Name: transmembrane protein 68
  ENST ID: ENST00000520061
  CDS Start-End: 1-326
ttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggttaatggaagattagatttctgattgctgatgggatatcatttctgaatcccattagaatcctatctctggaatctctgccctgccacttcttagatgtgtgactttgagcaagctattattctggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatatt

SEQ ID NO: 194333 - DNA, 726 bp, Homo sapiens
  Payload ID: 18400
  Gene Name: transmembrane protein 68
  ENST ID: ENST00000522470
  CDS Start-End: 1-204
ttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtggctttgactggaatggcatgctttcacatataaacatcctgctctaaggaatcaaagttgacttatagagctaataaaagccccttggaaaaactagcttcataccttgcctatgcattccctgtacaggattcttgacctgtgtatcaagattaagacaaaaaggttgcccccttcagcatgtcgagtcatgtgagggtggctaccctctggggctgcagctttctcactttggaagacttatgagttttttcctgtgccctgtacagtgaagaacaaagaaactagtgacagtttgatgagaaacagatatacacatagcttcaaagaatctctccataaagtacttattcattataaaaggaaaaaaataatttcatagggaagaaacctggtggatgacatcttaatcaagtgatcaaagttaccaccacgactaatgacacaaaccaacattatatgcctcctgatgtgatgtgacatgctagaaagaaaacaacatcatttatacggtatttctgccagagaaacataatctgcattttcatgttaaag

SEQ ID NO: 194334 - DNA, 1009 bp, Homo sapiens
  Payload ID: 18400
  Gene Name: transmembrane protein 68
  ENST ID: ENST00000519784
  CDS Start-End: 147-578
ggttgcttcggaggaatccgccgtgcaaatctgtccgcccccttggccactgatcccccgaagagcttctgtcgccgctctaggaatagagacattgaagtttgggacaagatatttatctaacttctggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcc

SEQ ID NO: 194335 - DNA, 536 bp, Homo sapiens
  Payload ID: 18400
  Gene Name: transmembrane protein 68
  ENST ID: ENST00000523073
  CDS Start-End: 84-518
cgccgtgcaaatctgtccgcccccttggccactgatcccccgaagagcttctgtcgccgctctagggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaacgaagaatgctgttcaagctttgattgataagcaccaaagaatacc

SEQ ID NO: 194336 - DNA, 710 bp, Homo sapiens
  Payload ID: 18400
  Gene Name: transmembrane protein 68
  ENST ID: ENST00000523423
  CDS Start-End: 219-710
gccactgatcccccgaagagcttctgtcgccgctctaggaatagagacattgaagtttgggacaagatatttatctaacttctgagttatctcaatatggctgggcatggtggctgatgcctgtaatctcagcactttgggaggctgagtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattcca

SEQ ID NO: 194337 - DNA, 2400 bp, Homo sapiens
  Payload ID: 18400
  Gene Name: transmembrane protein 68
  Uniprot ID: Q96MH6
  ENST ID: ENST00000521229
  CDS Start-End: 214-621
ggcttctttcacacgggttgcttcggaggaatccgccgtgcaaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttctgttgattcattcctgaggttggtgtgtctttctgaataaataagatagcaatagatttctctccaggatagtcattcttttctttattactcgagaaattttgatgttgtatacttaatgattggtggttcttctttgtttggccatcatgaaaattgccttctggtggcctatttttaagtggttagtgtttcactctaccaacttttacttcattattccaacaatatctagtttgttggtctcttttgtttttagactacacaaaaatactgaagattcaataggcaggtaacaaacattggctttctgtattatgttgttgagcatcacagtggtttcatagaaggacatggaaggaagcacagactttaaaagacacttgaggatatatatcactgaactattaggctgctattagcagaaatcaccagtgacatgcttattagactaatgtattttcattttaatactacatacatacttaacgaacctacaaattttttttgagcacctacctatgccagacactgtcaattgcttaatataaattaactgctttaaatctcattaacataatggagtctatgtggtaccccgattatactcatgaggaaactgaggcacagagaggttgttatttgcccaaggtatactaggaatagggccaggttacaaccccagatacctgggagtatacatttgagagagctcttggaggtaaaataaacagaacttggggactgagtgtagagtcttgagggaggaggagttaaagtccagtaagatttctactgctagacagggaaacatgaactggaagtgctccaagtaatagcaaccatgtgagcagaagcacaaaggtggaaaagtactctgggagccacagttagttcatatgatacatgaaataatgtaatgtcactttataggcaattggggcctcaaggggcttgaaaatgttggactagagtggtaatgcactgatactttctcagcagggagtagtatgatcacatctgctctaagagtgacacagttaaatagccctaggttttaaggtttactggcactatagtaaactattttttttaaatatttgattagttggatttttctgctttcaaccaggtggtttggtattatgtgagtagttcaattgtttattatttaaaaaaatactctgtaaaaccagagagaaccttggtaatattctgtatagaatccttcaaaggagtttctttattgctcagaaaatgtatttgatgggacagttgatcctcaaactcagtgactgttttgtagagcttaaagtaaattgaattacttgagttagaattatgtaattggaaagaaatgatataatatggaaacatacaaaatcttggaatatcattaaattatttttcaaaacatt

SEQ ID NO: 194338 - DNA, 707 bp, Homo sapiens
  Payload ID: 18400
  Gene Name: transmembrane protein 68
  ENST ID: ENST00000519780
  CDS Start-End: 162-707
ggcttctttcacacgggttgcttcggaggaatccgccgtgcaaatctgtccgcccccttggccactgatcccccgaagagcttctgtcgccgctctaggaatagagacattgaagtttgggacaagatatttatctaacttctggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaag

SEQ ID NO: 194339 - DNA, 639 bp, Homo sapiens
  Payload ID: 18400
  Gene Name: transmembrane protein 68
  ENST ID: ENST00000520414
  CDS Start-End: 261-639
agtctcttcgcgggcaggctcggcttcccgccggcctcagtgttgcgccccagcgccagagtggccgggtgtggagatcctccctcctctgggtcaaagagcctgctctccccgcccctcttctcccctggcgctctaaaccttcgaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataa

SEQ ID NO: 194340 - DNA, 1000 bp, Homo sapiens
  Payload ID: 18400
  Gene Name: transmembrane protein 68
  ENST ID: ENST00000522090
  CDS Start-End: 270-1000
tgcagccgccgcttggcttctttcacacgggttgcttcggaggaatccgccgtgcaaatctgtccgcccccttggccactgatcccccgaagagcttctgtcgccgctctagggtaaaggagagctgcccctgcccctgcccccgcctatccgagaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttag

SEQ ID NO: 194341 - DNA, 481 bp, Homo sapiens
  Payload ID: 18400
  Gene Name: transmembrane protein 68
  ENST ID: ENST00000522030
  CDS Start-End: 50-481
tatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatgggtttagtttattactggatgtgttttgtgctctacatggaccaagagaaaaatgtgttgaaattctgaggagtggccacttgttagctatctcaccaggtggagtt

SEQ ID NO: 194342 - DNA, 751 bp, Homo sapiens
  Payload ID: 18400
  Gene Name: transmembrane protein 68
  ENST ID: ENST00000517576
  CDS Start-End: 1-405
ataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatacta

SEQ ID NO: 194343 - DNA, 826 bp, Homo sapiens
  Payload ID: 18400
  Gene Name: transmembrane protein 68
  Uniprot ID: Q96MH6
  ENST ID: ENST00000522576
  CDS Start-End: 267-674
agccgccgcttggcttctttcacacgggttgcttcggaggaatccgccgtgcaaatctgtccgcccccttggccactgatcccccgaagagcttctgtcgccgctctagggtaaaggagagctgcccctgcccctgcccccgcctatccgagaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactat

SEQ ID NO: 194344 - DNA, 2477 bp, Homo sapiens
  Payload ID: 18400
  Gene Name: transmembrane protein 68
  Uniprot ID: Q96MH6
  ENST ID: ENST00000617782
  CDS Start-End: 115-1089
aatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaacctgagttgcagtt

SEQ ID NO: 194345 - DNA, 4512 bp, Homo sapiens
  Payload ID: 18400
  Gene Name: transmembrane protein 68
  ENST ID: ENST00000617977
  CDS Start-End: 2871-3146
atgaaagcttgcgtgccagtgtagaaaccatattcccagactatagtgaggaatactgagcctgctagggtaagctttcttttatttagtgggccctagaaatgtccagcttctagagaggtagctatttaaggaatgatatttcaacaggaaagtctttaaatgcatacatcaatacagaattctgggatcatgccagtcagtagatataaatccagccatactggttggaagtggcaaatggtatatgcatgagctgaaatatttctgtttcttcttggacattttaggttctcaactataaagacattttataactatttaaaacattaggatttcagccatactaatattttattttacaaaactagttttattttacaaaactagtagtgatttccagataacagtctgaattttttactgaagaattcagtgtctgagtattgtggaagctaccaaaataataataataataataattaaaggccaggtatggaggctcatgcctgtaatcccagcactttgggaggctgaggcaggaggatcccttgaaaccagttcaagactagcctgagcaacaaagcaagaacccatctctacaaaaacaagcaaataaactatatttacttatatgtataaataattcagtgtattttgtcttctttatcttcttgtgttttagctttatgagttaactccatcaaattttaatttcttcatttgactgctcttttttacttttaatttttttgagacagagtcttgctctgtcacccaggctggagtgcaatggcgtgatctctgctcattgcggcctccacctcccgggttcaggtgattctcctgcctcagcctcccgagtaggtgggttacagacgctggccaccacgcctggctgatttttgtatttttagtagagatggggttcaccatgttggccaggctggtcttgaactcctgacctcaagtgatccacctgccttggcctcccaaagtgctgggattacaggcatgagccaccatgcccggccctgactgcgcttcttttctttacctaacttctccccttttcctaactgattttgagattgctgctgtctatttctgacttttgtattcagagaatacaaattaattcatttagaagcattgtctctttgctctgtttactcactgtttgtttaattcctccatctcactttctgttagcacctagtggattccaggcacagttctaggtgctatacaacagtgaacaaaacaatgtccttgcagtatattaggcgtcttccttctggcgagaggagagatataacaaatgattggttagttatatgtgaagtagtaggttttatgaaggctttgcctgtagtctctttcctttagtccactgtattttactgttttccaaagcttagtaggaataacttttaagcttatttaaatatctcacctattaagcaggtaattttatattaggcatttactcatggttgactgtaagtaatgtaatactcccccaaccaaaattttatctattctgaaacatcatttaattcagtatattatgtatatttttaagtgtttcattcaattttttatctattttagtattcacagtggcataacctctttacatatcaatacttcattattttatatgtatttaaggttttcattattaaaaatatactgaatcattgatatttttggagaataaaaatcatgaacttattagcagaaattctctacaatcaattatggagaattcttttttttttttttttttttttttgggagacagtgtctcgctctattgcccttactggagtgcagtggtgtgatcttggttcactgcaacctctgcctcctggtcttaaacaatcctcccacctcagcctcccaggtaactgagactacaggcacgtaccaccgcaactggccaaattctttaatatatgtgcttttcctttttgtctgtgtggttgagtcttatagttacttttcattgatgttgagtattttagatttaatagactcacaaaaaattttaccaattccacgacagcatcttgccaaaacttgtcatttaaatatacataaatttccctttggagccaggtgcagtggctcacgcctgtaatcctaacactttgggaaactaaggttggaggattgcttgaacctgggaggttgagactgcagtgagccgtgatcacgccactgcaatccagcctgagccacagagtgagactctgtccccaactccccccgaaaaattacccttagaatccctgcttgcaacttttctccagtgagcgtactattcagtagcccactaaagacaattcagtttaccacattcattttatttagtgaaattaatgattactgtaatctctattttgagtttcaaggttttatgtgaaatgttaggaaaactggtcaatgaaatattatatattaccactggagggtagtgtttccaatttctatttttacaaatgatcaagttgaatttagttgatagactaatcgtgtgcttttattttaaaaatattttattttcataatatcaaacaggccctcaaaagtttgcataatcactttgtgatcccctcacgcccccatgctaatgaatttgtaccccttttctctttctcccatgccaatactaacgagacccgaccctgcttagcttctgggatcagacgagattgggcatgttcagggtggcatggccataggtgccttttctctttcttaaaaaaaaaaagtttgcattagttactctaatggagacattgaatggattaatttatttactttttaattcaaattctccttttctttagcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtg

SEQ ID NO: 194346 - DNA, 2439 bp, Homo sapiens
  Payload ID: 18401
  Gene Name: transmembrane protein 69
  Uniprot ID: Q5SWH9
  ENST ID: ENST00000372025
  CDS Start-End: 1158-1901
gggattccggcgagagcctgcgcttgcgacagtgccgtttctcctacctgaagtctcattgggtatcgcactactggaaggggcggcgctgccatgacagagaaggcaataaaactgaaggcctagctcgactaaaagcgcttactattaaggaagacttcgctgtggctccatccggcacggaaagctaaaccgtgtaatggctggcaaccaggaagctagactacctagaatccggaggattggagggactggccggcgtgggcccctgagatctcctactacatgtcttcagttttatccatagacacggaagggcactaaaattgcctggtgccatttcctgtgaaacaagtctagataagagaagggacttgcccaaggtcacatagccgagaaataaagccgagggcagtaggagaaatgatctgactttccgaaccacccccaagcctagggcccttatcaccacacctttcatggaagtgaaaatcctgctcttgtgctctttaacccttaatgaagtttataggtcccagcaaagaaaatggatgtaagaactgggcttttttccccctctaaatgatagtaaagggccctaatgcagtgagatgtgtccccataggccttataaaccctgttttgcaaagtaaaacataagtcccacagatggcaagcaattcaggtcacactgggcctaaaatcccgtctcttaccttccttcaccaccatcattctgagattgtttcagtacttgcactctacttacccgaactctgtgggcagattctgctgcctgggagccctggaatagaacttcaaggaccgttcaacatctggattcaactagaaattaagaatggcccccaaacagaaagccgggcctaggaaccaattagcgcaggtcaagtccctacccggactcattttttttcagccctcaggaagtaggggcctctctgaatccacttgccggaagtgcctttccagtggacctgggctgttgttgcggttgttttccttctctccgtgcaacgctggcaagtctcaaagtcgccacagaaacatgcccctgattcagtgcctctgcttagctgtaacatgttaatcagaactacctggcatcttcctgaacaagactttcaataggggccagtatgcttcgcttcatccagaagttttctcaagcatcttcaaagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgacagcccaaagccagcattatgtgtaactctggcaggactaatccccttcgttgctccaccactggtcatgctgatgacaaaaacttatattcccatattagcttttactcagatggcttatggagccagtttcctatctttcttgggtgggatcagatggggttttgctctaccagaaggtagtccagccaaaccagactaccttaatttagctagcagtgcagctcctcttttcttttcatggtttgccttccttatttctgaaagacttagtgaagccatagtcacagtaataatgggtatgggagtagcattccaccttgaactttttctcttaccacattatcccaactggtttaaagccctgaggatagtagtcactttattggccactttttcatttataatcactttagtagttaaaagtagttttccagaaaaaggacataagagacctggtcaagtataaaaaatataaaagtctgggaagtgaggagcacctctgcccagctgctgccccgtctgggaagtgaggagcgcctctgcctggccgcctgaccatctgggaagtgtgacaagcgcctctgcccggccgctgtgcaaccttccacgtgtgaagtgacagccttgtgtgtgatcttttctgtcttccccaagtttgcattttcgacattaaagtttactttttagttaaaagttttaaaaatatatatatataaatacactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatattagttttcactcagtcattttatgaataatatagttatccacttaaacatttcaatattttaaccatcttgaaaattaaagattaaaaatcccctttgtta

SEQ ID NO: 194347 - DNA, 2018 bp, Homo sapiens
  Payload ID: 18402
  Gene Name: transmembrane protein 70
  Uniprot ID: Q9BUB7
  ENST ID: ENST00000312184
  CDS Start-End: 74-856
cgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaaccagtgaagagaaacggcataaagatgacaaatgagcctatttgttagtgttcgtgctcaaatgtgatttacgttttaatgtataataataaaattgccttttgcattccgttagtgactgattgttaaaaataatttgaaattatcaaagcttttaatttccagagaatgatgtttgtttataataaaacaagctatgtttgaaaaccaaaatgtagtatctaccattcgtgttttagaaaggtatgtgaataaatatgttcatgctagtataagagttctgtgttactgtggttgactctaaactggggatctgatgtcagtagcaaatgggagagttgctttattctttgtgtatggatttttctaagtgtataaatattttccgacattaaaagacattttctctttgaggaagacacagtcataggtggtgcggagctgtggtccacctgctcctgctcctgactcactgctctttgctgttgcctgaggaccaagtctgtcaggaagctggctaggaagccttgcagcagccatggcttttaaacataccagaaaaacacccgtggagtcagaggtggcaattcaccgaattcatatcactctaacgagttgcaacgtaaaatccctggataaggtgtgtgctgacttgatctgaggagcaaaggaaaagaatcagtgaaaggaccagtttgaatgcctaccaagactttgagaatcactacaagaaaaacttacggtgaaggttctaaggcatgggatcgtttccagatgagaatccacaagcgactcattgacttgcgcagtcctcagatagttaagcagattacttccatcagtattgagccaggagttgagatggaagtcaccattgcaaatgcttaagtcaactgttttcataaattgattaccagttgttaaaaaattttcaaaaaaccgcaaaatttcaagaaattcacaaattatgggagcagttttaagtcttctttggttcagaacacaggtttttgcctaacccctggcatgattgcccataagaacatacatgtacagttgaactggtggttagctatacgggaaatggtaagtagtgttgtcttcagtatcttaatttgtttctgcaactgtgcactcctcccttggtggcaccctatgggtgtaggaaaaccactgttattaaacaggtgaaaaata

SEQ ID NO: 194348 - DNA, 928 bp, Homo sapiens
  Payload ID: 18402
  Gene Name: transmembrane protein 70
  ENST ID: ENST00000416961
  CDS Start-End: 88-423
acttgtgcggcagtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggctggagtgcagtggcatgatcttggttcaccatactcttcgcctcccatgttcaagcgattctcctggctcagcctcctgctgggattacaggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaacagacacttataaagccattacctacaatgctatgcttgcagaaacgagtacagtgtttcaccagaatgatgtgaagattccagatgctaaacatgtatttaccacattttatgctaaaacaaaatcactgttagttaatccagtgctctttccaaaccgtgaagactatatccatctaatgggttatgacaaagaagaatttattttgtatatggaagaaa

SEQ ID NO: 194349 - DNA, 617 bp, Homo sapiens
  Payload ID: 18402
  Gene Name: transmembrane protein 70
  Uniprot ID: Q9BUB7
  ENST ID: ENST00000517439
  CDS Start-End: 76-399
gtcgggtgggaagccgtgtctcgcagtcgtggactcgtgcagctggggcgtccgcagccgctcgtcacccgcgtgatgctgtttctggcgttgggcagcccgtgggcggtcgaactgcctctctgcggaaggaggactgcattgtgtgcggccgccgcgctccgaggtccccgggcctctgtctcccgggcgtcctccagcagcgggccttcggggccggtagccggctggagtacggggccttcgggagccgcgcgccttctccggcgtccgggtcgagcgcagatccctgtttattgggaaggatatgttcgattcttaaatacgccatctgacaaatcagaagatggaaggctaatttatactggcaatatggcccgagcagtgtttggtaagtaattggaggtgtgaaatgtttctcttattctacgagtctgattggccttacatttctgccatacatttttacacaaaataatgctatttctgaaagtgtgcctctgcctattcaaatcatattctatggcatcatgggaagctttacggtgatcaccccagtgctgcttcactttattacaaaaggctatgtcattcgattgtaccatgaggccacaaca

SEQ ID NO: 194350 - DNA, 1993 bp, Homo sapiens
  Payload ID: 18403
  Gene Name: transmembrane protein 71
  Uniprot ID: Q6P5X7
  ENST ID: ENST00000356838
  CDS Start-End: 144-974
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttatgtgaaatcattgtttctcagccttgccagctatttcaaaaccactgcctgtgctcggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagc

SEQ ID NO: 194351 - DNA, 1861 bp, Homo sapiens
  Payload ID: 18403
  Gene Name: transmembrane protein 71
  Uniprot ID: Q6P5X7
  ENST ID: ENST00000377901
  CDS Start-End: 144-842
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatcaactcttctccaagtgaagacaactggttgaaggggaccaggaggttggacacagaccattgcaatggaaatgaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttatgtgaaatcattgtttctcagccttgccagctatttcaaaaccactgcctgtgctcggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagc

SEQ ID NO: 194352 - DNA, 1974 bp, Homo sapiens
  Payload ID: 18403
  Gene Name: transmembrane protein 71
  ENST ID: ENST00000523829
  CDS Start-End: 123-1064
gacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcatttctgcatgtgcaagatggtttatgggagaaatattagccagtgtcttcacatgctcattgatgataactgtagcttgtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagcaaa

SEQ ID NO: 194353 - DNA, 545 bp, Homo sapiens
  Payload ID: 18403
  Gene Name: transmembrane protein 71
  ENST ID: ENST00000519016
  CDS Start-End: 422-545
aaaagaaaacaagagaagttgtaagactgactttcccaagaactatacactcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaatttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatca

SEQ ID NO: 194354 - DNA, 558 bp, Homo sapiens
  Payload ID: 18403
  Gene Name: transmembrane protein 71
  ENST ID: ENST00000522780
  CDS Start-End: 1-302
cagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcatttctgcatgtgcaagaaacaacaatgccaaccacacgatgggtgaggattaaacaggagaatgcacaggaagcttgcagcacctggtgagaactcaacgaaggtgtgggtccgccttctgatgacggaacctgttacagctgtctgtctgaagcgatgagatgaggcaacccttgctctgggaaggcagagtcacctggcatcatcaaggcctttagcacctgctaccacttgtctgctacgaagtaccagaaaatgacaaaaacctcggacttgaagcaaataaactaagtaaaaactctgaacacc

SEQ ID NO: 194355 - DNA, 556 bp, Homo sapiens
  Payload ID: 18403
  Gene Name: transmembrane protein 71
  ENST ID: ENST00000519187
  CDS Start-End: 260-556
gaggctgccgaagacaaaacttctctgcaagcacctgtgcacagcaatgtgcgtgggcatctgtgagaagaaggaatgtccaggctgataaaaactattaaaatcactctctgtgactacctgtcaatggttcaagttgttgggaaaaagacagacaccaatctccaagcactgtttgaaacttgataatgaagttgacttgtgtcagatgattaaaatacacagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtat

SEQ ID NO: 194356 - DNA, 496 bp, Homo sapiens
  Payload ID: 18403
  Gene Name: transmembrane protein 71
  ENST ID: ENST00000519304
  CDS Start-End: 222-496
actcatttataccaggaaacagacaagagaacaagaggctgccgaagacaaaacttctctgcaagcacctgtgcacagcaatgtgcgtgggcatctgtgagaagaaggaagcttcgtatttcagtaataattttgtcctttgtcaattggaagaagaggctgggaactccctttggaaggaacacagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaaccc

SEQ ID NO: 194357 - DNA, 596 bp, Homo sapiens
  Payload ID: 18403
  Gene Name: transmembrane protein 71
  ENST ID: ENST00000522334
  CDS Start-End: 407-596
aaaagaaaacaagagaagttgtaagactgactttcccaagaactatacactcatttataccaggaaacagacaagagaacaagaggctgccgaagacaaaacttctctgcaagcacctgtgcacagcaatgtgcgtgggcatctgtgagaagaaggttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttaggatatttagaaagaaaaagagaatctgccattccttttcttctctcttcaacctcagtacctccaaatcttggctgcatggaagtatctttggtgacatcaactcttctccaagtgaagacaactggttgaaggggaccaggaggttggacacagaccattgcaatg

SEQ ID NO: 194358 - DNA, 3009 bp, Homo sapiens
  Payload ID: 18404
  Gene Name: transmembrane protein 72
  Uniprot ID: A0PK05
  ENST ID: ENST00000389583
  CDS Start-End: 314-1141
gatctcaggcggctgggctgcgctggggctgagcggctccagcccaggctggggttgtgtgagcagcaggagcattcttccaaggtaatgattaagctgagtgcctggcaagggcacgggctgagagcacagaaggtgagccctattcacacctcggccaggctgcggtggccaggactggtttgggaaggcagggccccggtgtgcagccacagccagcagcctcctacctacacaagggtgttcgggagcatctcagggccgaagactttgctgcctgccctgccaggactttgtcctcacccctggcaccatgcagctccaggtgttctggactgggctggaatacacctgccggctcctgggcatcaccactgctgcagtgttgatcggcgtgggcactgagaccttcctccagggccagttcaaaagcctggctttctatctgctgtttacaggagccgctgtctccatatgtgaaggggcctactttgtggctcagctgctggccatctgcttccagtgtcaaccagggtccctggcagacagagtaagggagaaagcccactggctgggctgcttccagaagttcctggcctacctgctgctgtcggtggcctgcttcctccacccggtcctggtctggcacgtgaccatcccaggctccatgctcatcatcaccggcctggcctacttccttctgagcaagcggaagaagaggaaagctgcccccgaggtgctggcctccccagagcagtacacagacccctctagcagcgctgtgagcaccaccggctctggggacacagagcaaacctacactttccatggggccctcaaggaggggcccagctcccttttcatccacatgaagagtatcctgaaggggactaagaagcccagtgccctccagccccccaacaccctgatggagctgagcctggagccagccgactccctggccaagaagaagcaggtgcactttgaagacaacttggtccgcatagtcccctccctcgccgaaggtctggatgatggggacagtgagccagaggagaccacctctgacacgacacccatcattccccctccccaggccccactcttcctgtcatctcttacagccaccggcctgttctgagcgcttgctccagcctggaggacgctcagtgaggggtctacctagctcaatggccctccctggagtttcagggtcttctctggtcagcttttcaaggggtaaccagacacccccacactggctgggcccctgaggccatcaggaggtgtgactggccagcatttctggagaggcctcgagggaggcacaaacaaggctcacgccacctcaagccagcacaagctccttcctcctggccacaggtggggaaacccttatgcttccccaacaagaccatcactgccactgcgcacgaggctgcaggtgccattgactcagcccagaagggacagaggatgtctgcccagcaaaagcctctgggcttttcttactcccaacccagggcacaacactcagtgaggaacctatggtccacccatctctgcaggcccagggaagtgtcagtaacttaagcatctctaaggcagagaaggtggctgtgggtcttgaccaaccaagactgctcagggtcgggaggggaggctgcaggcctctggtgggagcagccgggccgtgggccacattctctgcatgctctagggctggggctgagctgctcaggaaaacaatgccgctctgtgctcactgtgggaaagccaggccagatgagcaaagctcattccagaaacatggctggggacttccagcctccttaccacatggcctttccaagattccaggttgatgatgcaaactgaacgcagtgaatgccagggcccagaaggcaatgtctgctgtgggcaggaccacagaggctgcccaggggtggcacagcacagagaagtgtcagtgccgtgtttaggcacttggtagcagaataggtgataaatataaatgtcttcaaaatgaaaggaagtgaggggggaagaagaggagggaaaatgggaggataggaggaagtgggcaggcaggcaagttctctgccatggggccacggaagtgacagttaacccagaaggaacaaagacatctgaatcagatattcctttgtaaatctgtaaaggatttgcaatataggctttacttctaaaaattgttgtcgggtccatgaggctgttgccaggaagagcacacacaccattcttcatggcaactgcagtgagggagcagtcaggaggaagagtcctgtggcttctcagtccctgtggaggctaacgcaaagctctgtagaacaagccttagagtgcatgctctatggtctaatgagaaacttgtgtttgtgcttgcacacgtttcaatgttccctacaggatattttacaaaggtatgaaaataatggccaaccagaagctagtatcagtttggggcctaaatgcagcaggtgttcctgataagcagataagcagagctcttcctgcagtagcccaggtctcaccaaatgacaaatggctaatcaagacactcctgcaagcccttgatggtgagagctgcagagctgtttcttcagctgccatcaaggcaggacctcaggacctgactgtctacagtcagggaatagtgaacaatatgggatatgggtataggtaggtggtagacaaggatcgtgccccatggctgatgggccgggtgtctcaggcaggccccctgtgcacagaaagagcctaagtgcagagaagccaggcatctttcccctgtcaactgtggaaggggaatgtgatggccacagacaccctcatggcacagacatggccagcctctgacgttcctctgcatcagagtagttctgtcctcgaagccccagtcagcagagctggatgaccagatcgcaagaagcaaaccagaaagtgtgatggcagagatgtcagatcccgtttaataaacacttcagt

SEQ ID NO: 194359 - DNA, 1018 bp, Homo sapiens
  Payload ID: 18404
  Gene Name: transmembrane protein 72
  Uniprot ID: A0PK05
  ENST ID: ENST00000544540
  CDS Start-End: 485-958
cgggctgagagcacagaaggtgagccctattcacacctcggccaggctgcggtggccaggactggtttgggaaggcagggccccggtgtgcagccacagccagcagcctcctacctacacaagggtgttcgggagcatctcagggccgaagactttgctgcctgccctgccaggactttgtcctcacccctggcaccatgcagctccaggtgttctggactgggctggaatacacctgccggctcctgggcatcaccactgctgcaggtttacaggagccgctgtctccatatgtgaaggggcctactttgtggctcagctgctggccatctgcttccagtgtcaaccagggtccctggcagacagagtaagggagaaagcccactggctgggctgcttccagaagttcctggcctacctgctgctgtcggtggcctgcttcctccacccggtcctggtctggcacgtgaccatcccaggctccatgctcatcatcaccggcctggcctacttccttctgagcaagcggaagaagaggaaagctgcccccgaggtgctggcctccccagagcagtacacagacccctctagcagcgctgtgagcaccaccggctctggggacacagagcaaacctacactttccatggggccctcaaggaggggcccagctcccttttcatccacatgaagagtatcctgaaggggactaagaagcccagtgccctccagccccccaacaccctgatggagctgagcctggagccagccgactccctggccaagaagaagcaggtgcactttgaagacaacttggtccgcatagtcccctccctcgccgaaggtctggatgatggggacagtgagccagaggagaccacctctgacacgacacccatcattccccctccccaggccccactcttcctgtcatctcttacagccaccggcctgttctgagcgcttgctccagcctggaggacgctcagtgaggggtctacctagctcaatggccctccc

SEQ ID NO: 194360 - DNA, 1741 bp, Homo sapiens
  Payload ID: 18405
  Gene Name: transmembrane protein 74
  Uniprot ID: Q96NL1
  ENST ID: ENST00000297459
  CDS Start-End: 180-1097
ggcgggcgctgcccacccggcggagccgagcggcgtgcagaggctacaagtgccgtagctggtgattgggggactttctccgggaaccgtgccgggagagcgcgcggtgctggagccgcaccgggtggccgaagcagaagactttccggaagctgctgggggatgtctgactagctctcatggagctccactaccttgctaagaagagcaaccaggcagacctctgtgatgccagggactggagttcaagagggctgcctggtgaccaggcagatacagcagccacaagagctgctctctgctgtcagaaacagtgtgcatccaccccaagagcaaccgagatggaagggtctaaacttagttcttctccagcatccccctcctcctctctgcaaaacagtactcttcagccagatgcctttccaccaggacttctccactcagggaacaaccaaataacagcggaacggaaagtctgtaactgctgcagccaggaattagaaacttcttttacctatgtggacaaaaacatcaacttggagcagcggaaccggagctcgccatcagcaaaagggcataatcaccctggggagcttggctgggaaaatccaaatgagtggtcccaagaggctgccatatctttgatatctgaagaggaggatgatacaagttcagaagccacgtcttcagggaagtctatagactatggtttcatcagcgccatcttgttcttggtcactgggatcctgctcgtgatcatctcttacatcgtcccacgggaagtgactgtggaccccaacactgtggcagcccgggagatggagcgcctggagaaggagagtgcgaggctgggggctcacctggaccgctgtgtgattgcggggctctgcctcctcacgctggggggcgtcatcctgtcctgcttgttaatgatgtccatgtggaagggggagctctatcgtcgaaacagatttgcctcttccaaagagtctgcaaaactctatggttctttcaacttcaggatgaaaaccagcacgaatgaaaacactctggaactgtccttggtagaggaagatgcgcttgctgtacagagttaattctggttgtgaatatcttgagagtctgccttggcattttataatatgaaaaaagttaatttataaaaattcacagtgcaatttatttgcctggcaagaaaagtttatttcacaaaccaacagccagtaagtgtttttgttctctatgtgtcttctatttagaagaaaagccatgtaagatgtataagaaaccacaaccagccacacctatccttctgaagagctgaaggctaattaatctgtaatggccaagaacttctacttcgatagaaaaatatttctaatgacccagtctacaaattatttcttttacacaaatatatgatgttattctttggacactaggtggtcctacacacagtaggatcaattgctaatctactttgtgaaaaagaactaagcactaatcaataataaggcttacatctaattctcaaaggtgcttatccattttcttgctaaattatccttcttgtaatttggctaaacactaaaacatggaatttttagtttgaatattttgaagtttgaggatgttgggctttccttattgtaaaaaatgttatgtttgaaattattcctgttttcaaaaatggtaattaagtcattaggataaactttctaataaaaaaaaattatgtaaa

SEQ ID NO: 194361 - DNA, 1730 bp, Homo sapiens
  Payload ID: 18406
  Gene Name: transmembrane protein 74B
  Uniprot ID: Q9NUR3
  ENST ID: ENST00000381894
  CDS Start-End: 673-1443
gactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagggtgtgggtgggggccacttctgagcacccatgtggcacccactgctggtccctgtttgtggctgggcactcaggaaaatgtttttggtgctaagagtaaaaagccaaccaacaaacacatctcttttttctgtctattcactggaaagtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttgga

SEQ ID NO: 194362 - DNA, 983 bp, Homo sapiens
  Payload ID: 18406
  Gene Name: transmembrane protein 74B
  ENST ID: ENST00000429036
  CDS Start-End: 522-983
ctcactcccaggggcactttgtgtgtgtgtgtgtgtgtgtgtgtgtgtgtgtgtacgcgcgtgtgcgtgtgacggggtactcgcgtggcccgaagatccgagggtcacactacgtgacttctgggtgtctgtgggtactgctgtgggaacagctgctgggggagtgtgtgtggaactggagtgttcctttcaggacctgtctgactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctggtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtg

SEQ ID NO: 194363 - DNA, 2175 bp, Homo sapiens
  Payload ID: 18407
  Gene Name: transmembrane protein 78
  Uniprot ID: Q5T7P6
  ENST ID: ENST00000323223
  CDS Start-End: 60-470
aaggtagagacaaccatgaaagttgaacacgtcatctgtgcaggaccgttcatactgacatgtggcttgacaccagaaatctgggtattgtaatatcatgttggaaaggagtttgtgtgcctcaaacaactactctagagatgttttacaatgacaatgatagagtagaggaatcttctaattcctaccaaatcagaagggaattcctccttcctgcctgcctgcctgccttcctttctttctctacttccttttctttctttctttccttccttcctctctctctttctctctttcttcctttctttccttctttctttctttctctctctctctccccttccttccttccttccttcctgagacaaggtcttgctctgtctcccaggctagaatgcgatggtgcaatcatgattcactgcagcctcaacatcccaggctcaagtgatcctcccacctcagcctcctgagtagctgggactacaggggcttgccaccacgcccagctaatttgcgtgtgtgtgtgtgtgtgtgtgtgtatgtggtagagatggggtctcactatgttgcccagctggtctcaaactcctggtcataagcaatcctccacctcggcctcccaaagtgttgggattacacgtgtgagccaccatgcccagtctctatttcttaatagtgtcagcaactgaaagatatagaaaaggaagtctgtttggtgtgtctgttgcctccccaaaatcttcagcctttgtaggacagtgcatcccactgggcaaaaccagagaatattcttttgtgagcccgtaagtaattgtctgcaatagacatgcaggggcctctactgtcatctcttatgcaactgaacttcctaaaaactgtggtgtttatctcttctgttgctcagcactgctgggactgggactgcaaaaaacaaaaaagcacccaggtttactgcccttaaaaaactgactgctagaggagatgagcatatacatgacaggatgtgataagatattaagcagaatgtgatcagaatcataggaagtatatacaaaagatgggaacactaatagaggtgactacaaccacctgctttgtagaggagatgacattcaagctgagttttaaaggatgagtaggagttggccagaaatggagagggagaataaaccatggggaagtagtacacaggcatggcatgtttagagcatttttggagcagggtaaccagaatatactggaggttgctagtagaggagattggaaaagaaagggtcagattattaatggatttacgtattatgcaaagaagtttatatttgaccctttttttgacaatctggcatttagccttatcataaaataaagatctctcaatgcttcacatagaaacttcatctgatctcttgaggatcaaaaaatggctttctgggttttttttctttctctctctcttttgtttttaatatctcacatatactttaaccaccataaattcaagttttctcttactcagacatgagttgcttaacaatggaataattcatttctttatttctcaacattgcccttttgaaggttttaggttttaggttttctaaaactctgaatacttttggctatcattatccagggaaagcctgaagacactccaaagcacaaggacaaaagagaccttgttagatctaattaagcgctccagcaccaggggcacggggagcaagagaaaaatacagagtcagaaactgagccgagttctatggtggtacagagtgaggcctgcttcactgtgggctggggctggggcagggaggccttcatcttgctctaagctgtgcaaagtacctcccacgaggctaagtatagagctactcaataaaaattatgcaatgtggctgggcacggtggctcacatctgtagtcctagcactttgggaggctgaggcaggtggattgcctgagctcaggagttcgagaccagcttgggcaacacggtgaaacctcgtctctactaaaatacaaaaaattagctgtgcatggcagcatgtgcttataatcccagctactggggaggctgaggcaggagaatcgcttgaacctgggaggcggacgttgcagtggggcaagatggcgccattgcactccagcctgggtgacaacgcgagactccatctc

SEQ ID NO: 194364 - DNA, 2191 bp, Homo sapiens
  Payload ID: 18408
  Gene Name: transmembrane protein 79
  Uniprot ID: Q9BSE2
  ENST ID: ENST00000295694
  CDS Start-End: 162-1346
ggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtgtgtgtgtaacaataaattactaccagtc

SEQ ID NO: 194365 - DNA, 975 bp, Homo sapiens
  Payload ID: 18408
  Gene Name: transmembrane protein 79
  ENST ID: ENST00000357501
  CDS Start-End: 157-684
catggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctgg

SEQ ID NO: 194366 - DNA, 2201 bp, Homo sapiens
  Payload ID: 18408
  Gene Name: transmembrane protein 79
  Uniprot ID: Q9BSE2
  ENST ID: ENST00000405535
  CDS Start-End: 172-1356
aggttttgagacacaggtaaagggagggagacagagagaaatacttgcagagccagcaggtagctgggcagctccttcccggacggacggatggacagacgctggggaccctccactccatatggaaagatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtgtgtgtgtaacaataaattactaccagtc

SEQ ID NO: 194367 - DNA, 524 bp, Homo sapiens
  Payload ID: 18408
  Gene Name: transmembrane protein 79
  ENST ID: ENST00000456810
  CDS Start-End: 129-524
cttgcagagccagcaggtagctgggcagctccttcccggacggacggatggacagacgctggggaccctccactccatatggaaagatgacatgaccttgtggtagatcccagaactgaggccccaggatgacagaacaggagaccctggccctactggaagtgaagagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgc

SEQ ID NO: 194368 - DNA, 1094 bp, Homo sapiens
  Payload ID: 18409
  Gene Name: transmembrane protein 80
  ENST ID: ENST00000397510
  CDS Start-End: 182-832
aggcggctgtcgtccccggccgacagggctggacggctctaggcagattctcgccggcggccggcgcaattctgcctctcagagagagcttagtgccgcgggtttcgcccgttcccgccgccggcggaagccgagtcagcccgaggccgagccgagacgagccgaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcg

SEQ ID NO: 194369 - DNA, 1572 bp, Homo sapiens
  Payload ID: 18409
  Gene Name: transmembrane protein 80
  Uniprot ID: Q96HE8
  ENST ID: ENST00000397512
  CDS Start-End: 111-593
tccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctgaa

SEQ ID NO: 194370 - DNA, 1047 bp, Homo sapiens
  Payload ID: 18409
  Gene Name: transmembrane protein 80
  ENST ID: ENST00000526170
  CDS Start-End: 1-665
atcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccagtggccacggtgagctgcaggacagccctgaggacccacttcacacaccagcgcctgagcgcctcgggccacctccctcaccagcgcctgcactcgcagaagaccagctgggcacacctgccatctggaggacccagcccacaaaccatgcagaccagggaaggaccccctccctgaagctggagacctgttgccttcatggttaatggatcctgatacctccagtctcagcgagcacacaaaggcagtggtcacctgttccacagggaacgccatggctccaggtgacccggagtggatggggcccgagaggccagcctggactgtctcctgagggcaggctccgcactcaaaatcgtgttgacaggcacccgtttaggagtggagagggaccccaccccccagctgtcctctccagcgcctgtttcccacttggccactcccagctctgcctccaggaagggtgagggcacgggtgcaccgaggggttggcgtgtgtgaccctgagctctgggtcagggcaagctcatgcatggagcaggatcacggcaggttcctggagatcaaacggcaaaggctgtaaaccag

SEQ ID NO: 194371 - DNA, 669 bp, Homo sapiens
  Payload ID: 18409
  Gene Name: transmembrane protein 80
  ENST ID: ENST00000488769
  CDS Start-End: 1-287
gaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggtgagtggactgttaacaccgtgaagaacctgtcctaagagttgctatctgtttccacagcctttcaagagtaattattttatagtgtggttctcagagacattttttatccaaactgcttacccagttgctttgcaggctcaccttacagtgtcattaagtattaatcaagaagttttgtcccagagacaaataacactgggggcatcgttgggagagactctgtgtttggaagcatgtcttgtagaagccactgggtaatggcactgagatcagaaaagcccagcccaccaccacatctggagctccggaatattcaccagcacccctttccttccccttgcccttagctgtctgaggagagagccctggagagttctgccaggtcccaaaaggcagcagagtctggaggggtgggag

SEQ ID NO: 194372 - DNA, 800 bp, Homo sapiens
  Payload ID: 18409
  Gene Name: transmembrane protein 80
  ENST ID: ENST00000608174
  CDS Start-End: 19-408
gaatgtccccgaggccgaatgctcccgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctg

SEQ ID NO: 194373 - DNA, 1332 bp, Homo sapiens
  Payload ID: 18410
  Gene Name: transmembrane protein 81
  Uniprot ID: Q6P7N7
  ENST ID: ENST00000367167
  CDS Start-End: 141-908
gttttattgacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcggcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagactcgtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagta

SEQ ID NO: 194374 - DNA, 1520 bp, Homo sapiens
  Payload ID: 18411
  Gene Name: transmembrane protein 82
  Uniprot ID: A0PJX8
  ENST ID: ENST00000375782
  CDS Start-End: 139-1170
gctctcctcccctcccctcccctgggcctttgacccctcccagcctctctccttccctccaccgacacctttgcccagtgacgttggtctgtccttacgcagacctggccggaggctggggctccttccggggctgccatgttctctcttccatccctcccctcctggctccccggcctcccctccctcgagtggggctctagcctccttgactccctcctgcaaggcctgatcggggcccttggagtcttggtcctgaacagcctcctgaaagtttacttcttcgtgggctgtgccaatgacccgcagcggcgacccgaaaaggagcggcttcgggcccagtgggcctccctggaaacggtgcacctggcagggctggccctgtttctgacggtcgtggggtcccgggtggctgccctcgtggtgctcgagttctccctccgggccgtgtccacgctgctgtccctgggcaagggctcccagggtgccgccgagaggctgcagctctacctgctgtgccagtactcgctgggctgcgggctgacctgtggcctgagcttcctgcaggagggcgcccctcaccgcacgctgaacctgctgctgagcctcgggctggccacgctgctgggcctgggtgcccggcgcctccaccgccacgtctgccgcctctacgagctgcacagcagccagcgctactgtggggtgtgcctgggcctgctggcccatgcacatggcctcccccagctgctgggccgtgccctggccatagcctttgccgtgggtgacctggcagctgtggccctcatcaaccaggacttcctgaccacctcggaggccatgcggttctggacaccgctcaccatctgctacacgctgctggtcatctacatgcaggaggagcagcggcagcaccccggcctgcagagccaggtgcagacggtgctggtgcgcatgggcggcctcttcgtgctgctgctgactgtgggtcgctggctggacctgctgggcatccttgtctccctactgggcgagctctggtgtctcgtgggcgtccgcaccctgcttgacctctgccagatacaggattttccatcccagaggcctccagtgtcaacaccaagccagcccctgccctcggcaccccagtcccagagttcggccccctcttgacctgcctcagggaggatctggagtctgtctcaagcccactagcctgatctccgaggccttgaccccagggcgatgcctggaggcagagtggcagagctggcctcctgcccagagctcagcacaggccctgggagccccgagaagggaaggcaggatttggggatgggagcctctggagaggggacacctggggacccctggttgaaccctctttttcttggggtgggcaatgatgcagcctctcagacctgccttcctgggcaggggtgggggtgcatcctcaggagggctccccctttactggtctcccttcccttctccatgaacaataaagacgatgtctttctcaa

SEQ ID NO: 194375 - DNA, 3595 bp, Homo sapiens
  Payload ID: 18412
  Gene Name: transmembrane protein 86A
  Uniprot ID: Q8N2M4
  ENST ID: ENST00000280734
  CDS Start-End: 97-819
tccgggctttgtagaatcgtcgccggcttacctggccgtgggcgcgtcctggccgctgcagcccggagcagggtgccagccgccgccgccgccgccatggtgtccccggtcactgtggtgaagagtgaaggacccaaactggtgccgttcttcaaggccacctgcgtgtattttgtgctctggctgccctcatctagcccatcgtgggtcagcaccctcatcaagtgcctgcctatcttctgcctctggctcttccttctggcccatggcctgggattcctgctggcccaccccagcgccacccgcatctttgtggggcttgtcttctctgctgtaggtgacgccttcctcatctggcaggaccaaggatacttcgtgcatggtctgctgatgtttgctgtgacccacatgttctacgcctcggcctttggcatgcagccactggctcttcggacaggtctggtgatggcagcgctgtcgggcctgtgctatgccctcctctacccatgcctctcaggtgccttcacctacctggtgggggtctatgtggcccttatcggcttcatgggctggcgagctatggcagggctgcggctggccggggcagactggcgctggacagagctggcagctggcagtggtgcactcttctttatcatctcagacctgaccatcgccctcaacaaattctgttttcctgtgccctactctcgggcgcttatcatgtccacctactatgtggcccagatgctcgtcgccttgtcagctgtcgaaagccgggagcctgtggaacactacagactgaccaaggccaactgaggtgccagggtctggtcacccctctctcctcctggggctggggcccagatcctggggacctgcaggagctggatcaggatggctgcagtgccagcctggggcagcaggtactgcctgaggaatttgcaagttcgtgtggggaggctggaaaaggatctccctagcagaactcgtggttcaggacaatgctgagagctaaaagagccagcctaatatcagactggagccagaagtagacatctccccacctctaccctatcaggactttcaaaacccccctggaaggtgatggtgctcagcttcttgacacccccccacccacttcccctaccaggtggaagagtctgactccatgtgttatgcctaggaccaatggcagtgctgggttcacccactcctcccctttttcatctgcacaaagttgagggaaacgggagaatctgtgctgagaagactcagacccaggagcccctttcacaggcccctagttgggaagactggatgagagtggagcctccgtttcttttccctcttctatccttgttacttgaacaatctcagtctctaagtggtgggtggggacatgaagaggtgtgggtccaggttaggcaggagagagaacttctttggtctcggagtttggggtctcaagaattcaagtagccccatctctctctcgggcaagcccaaagctcaggtcccatacgctacccttagatcctatccccagggctagggtgaaccatgccaaaggaaggggccagcttctctgtgtgtgtgtgtagcctgtctcctagtctgcctatgtctttctctgctatatgtttctgtcctgctgtctgtcaaaagtctcacagagagagggcctcagggagctgctgaggggtgctgagcctggctcagggagctgggacccctcccctccaacacacatactcacagtgctttcctccttgtccctcctacactaggagcaagaggagggggctccaatgacactccggggttttaagacccaaggcacattcaatgcaaggggagcaaggatgggacaactccatcttctgctgcccatgtgaaaaataataaaaatcaagagccattggctgccctgcttgtgggcctgtgtggcacatgcctatcttggagagggcatgggggcatggtgccagaggctctggctgtcctcacagcctagtcacagtcctgggcagtgcatcttggtgccaggctggctacctggctctggtgacactgtgccggttggagtgtgtctcacttccctggtgtgggtgaggatgtggtttaggaggatgggggatgagtggtatttgccactgtccaaatttgtccttgatgtactcccctgtgcacaggtgcccagcacccttggtgacctttagttacccagtgtcatctattgctgcccacctcctcccctccccacttgagacctgctgcttccttcaaaatgatccagattcccttcaagcatctccctcatcctggactctgggcttagttgaacagctgggagcaatgggattagattggctgattcattcattagttgtaaagccctggcagaataatacatcactctgctccaggagcatttgtaacttaacagacaatgccctaacccagaagtagaaagggaagccttgggtggtggtggatatgccatcagtagaggtgttgctcatttgtggggatgtgatttaggagactcaagtctcaggggtggttggatgagtcagtgatttccaaattagtttttacagagattcctggtaagggggtagtgaaggaataatgagagaaggcaggctcaaagacctcctatccttatttcaagtccagtagcttcttaggttgtgtttttttttgttttgttttgttttggaaggattccactgaaaaacgtaagtttgaaacttagtgagctggatgatcaatcccttctagctctgaaccctggacactaaagagggaagatcttgatcctttcaaacttcagaactctgaacacagacctacctagtgtgaagaaatgggagggagcaggatggagagcaggatgaagtcagcaggacttgcccccaagctctgaggggagggggaaagtgccatgtagatgtggaggaggggaagggaagaccaggcccagtcacaagaaggctggtcactgccttgtgggtgggtttggactaggctttcaggggtccaggtctgggattccctatcatgcaatcacatccatccccttggtccctgctgtatatcaccctcaggaacgggaaaggatgagttacgtttattgccccatcccttcactgaatgtttacattaacaaacaccagagagcaaactgggcttcctacactgggccatgcagaggacaggccaagaaactccacatcataacagcctcctgatgcctgggcttggctggagctcacatgaggtgctttgatttcttctgcagactctcggtgatggatgctacaactgacttatcatctttgtctgaaagagcaaaggaagtattcgttatattaatgatgctggcgaccagggaaattccaaactgctggacttcctatgcaggaaaccaggagctggaccctgggacccttaatcttgggttggcagagtgtgaaggggcaagagctgccatttatctagcacttaatatttgccagacattgtgccaggcagttgtgtactgtctcatttaagcctcatagtcctataaagaagatgagaaaacagg

SEQ ID NO: 194376 - DNA, 1637 bp, Homo sapiens
  Payload ID: 18413
  Gene Name: transmembrane protein 86B
  Uniprot ID: Q8N661
  ENST ID: ENST00000327042
  CDS Start-End: 524-1204
cctggtcacccattgaagcagtgtttgtggtggagcccctgagggcttggtggggttgagcagaatgaggaaaggtttcatggagcagggagggagacggctagggcagcaagtgaaggacagactcgccttcccatccctccaggggcactcctgccagccagcccctctcccgcttcccatgatggggtggctgttggaattctgcaccccatctcttctgattgttggggcccaggacaaggggacaggcatttgtgggcctaacctccccaggcagataggaggaggaagccatgtcccagcaggctagggcagagggacccccagtgccaacagtgctttatcagcgggcgccaggcagggccatccccagggtgaggacaacatctccctgggccctgttatcagtcacagagtccacaggacgctccttgggttaacgtgtaaccatgagccctcccctccaccccctgaagccactcgctcccagattaggtcgctctggggctatcaggccagcatggacgctggcaaagcggggcagaccctgaagactcactgctcagcccagcgcccagatgtctgcaggtggctgagccccttcatcctctcctgctgcgtgtacttctgcctctggattcccgaggaccagctgtcctggttcgctgccctggtcaagtgcctgcccgtcctctgcctggctgggttcctgtgggtcatgtccccaagcgggggctacacccagctcctccagggagcccttgtgtgctcggctgtgggggacgcttgcctcatctggccggcagccttcgtccctggcatggccgcctttgccaccgcccacctcctctacgtctgggccttcggcttctctcccctgcagcccggcctgctgctgctcatcatcctggcccctggcccctacctcagccttgtgctccagcacctcgagccggatatggtcctgccggtggcagcctatgggctgatcctgatggccatgctgtggcgcggcctggcccagggcgggagtgccggctggggcgcgctgctcttcacgctctctgatggcgtgctggcctgggacaccttcgcccagcccctgccccatgcccacctggtgatcatgaccacctactatgctgcccagctcctcatcacactgtcagccctcaggagcccggtgcccaagactgactgactagggagcttgaagggccggtgttcaggccctctcctcctgcaaggacctgggcctcccagcccagcccagcctgagaaataccctcagcagcgaagcttcctgacgcctgtctgcaggcgccgctgccgccgtcgcttctggctgaagacgtttgaggacgatttgcggaattccaagtccactactgggttccagctgccttcccccggttctgactccagatccctggctcctcagccaggcccacatggagccctcccagccaccagcctgcctccatgttcactgtcggccccacagcctgcccgccccctgctgctgctctgaatccgttttccctgtgggtgtggaaccgtagatgttgctgttaccgtaggagaggcctcggggagggtcatgattgtgataaaccatcgcggttaatgacagc

SEQ ID NO: 194377 - DNA, 1598 bp, Homo sapiens
  Payload ID: 18414
  Gene Name: transmembrane protein 87A
  Uniprot ID: Q8NBN3
  ENST ID: ENST00000307216
  CDS Start-End: 39-584
ggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgttctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagtgtcttattgtatgagtacattgcaatttgttcaattctctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaa

SEQ ID NO: 194378 - DNA, 3109 bp, Homo sapiens
  Payload ID: 18414
  Gene Name: transmembrane protein 87A
  Uniprot ID: Q8NBN3
  ENST ID: ENST00000389834
  CDS Start-End: 266-1933
agaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaa

SEQ ID NO: 194379 - DNA, 3049 bp, Homo sapiens
  Payload ID: 18414
  Gene Name: transmembrane protein 87A
  Uniprot ID: Q8NBN3
  ENST ID: ENST00000448392
  CDS Start-End: 309-1793
agtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcgttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggc

SEQ ID NO: 194380 - DNA, 581 bp, Homo sapiens
  Payload ID: 18414
  Gene Name: transmembrane protein 87A
  ENST ID: ENST00000566474
  CDS Start-End: 465-581
ctttttcttcctctgcacttcttggtccctgggtaattctgcttacgagatggttcgacttcgcttcaactttggaatggctattctaagctttactgtgtgactagaaagcatagagatttaagaaatgtgttttaacatgggaatggttaaaattgaagaaatagtacttaaaatttaatgtggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgca

SEQ ID NO: 194381 - DNA, 905 bp, Homo sapiens
  Payload ID: 18414
  Gene Name: transmembrane protein 87A
  ENST ID: ENST00000568400
  CDS Start-End: 396-905
ctgtgattaggctagcgggaatgtaagggccacttcagcaacagaaaggagtggtggagcggcttctcatcagaaaaacagaactttcagtgcctgacttgagatgtaaacttgatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctg

SEQ ID NO: 194382 - DNA, 867 bp, Homo sapiens
  Payload ID: 18414
  Gene Name: transmembrane protein 87A
  ENST ID: ENST00000563371
  CDS Start-End: 536-867
ggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagactaggaggattggttggtcttttcttggatttgattatggaaagctacctgatgcatctggttgctggaggctgactacttttagatgtgctgtaatctttccagggtcttggcttattgaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactg

SEQ ID NO: 194383 - DNA, 1369 bp, Homo sapiens
  Payload ID: 18414
  Gene Name: transmembrane protein 87A
  ENST ID: ENST00000569075
  CDS Start-End: 35-208
aaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcgttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggttagtactgcttaatctcattttctgtggtcagttcaattatattgtttacatcttgacagtgtggattggaaatgtctgtgggcttctttctgtttgctttaagtcacttttgggctctgattttcaaaatatatgtatagttcatgttctcttttaaatctattagagctttgtaaatttagtgtgtgcccgaatgaatgcttttccacctgtctccaaattgctaattgttttagttcctcctcccaagcagtagacttgcatttttttttctttttctaatcaatggaatccagactgaaatccagactgaaattcttgtgtaaatggc

SEQ ID NO: 194384 - DNA, 750 bp, Homo sapiens
  Payload ID: 18414
  Gene Name: transmembrane protein 87A
  ENST ID: ENST00000568432
  CDS Start-End: 470-592
ctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgttctcactacctaaaccccagttttatttgtacagaattt

SEQ ID NO: 194385 - DNA, 583 bp, Homo sapiens
  Payload ID: 18414
  Gene Name: transmembrane protein 87A
  ENST ID: ENST00000566014
  CDS Start-End: 1-583
cttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactgggtatttttcttatcccttgactctgatagtaaacctggccctctcagcaattgacgcctgtgttattttatggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagagg

SEQ ID NO: 194386 - DNA, 528 bp, Homo sapiens
  Payload ID: 18414
  Gene Name: transmembrane protein 87A
  ENST ID: ENST00000561578
  CDS Start-End: 266-528
tataacatgttactgtactgaatgctataggtggttgtaacacaatgttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgattgt

SEQ ID NO: 194387 - DNA, 5212 bp, Homo sapiens
  Payload ID: 18415
  Gene Name: transmembrane protein 87B
  Uniprot ID: Q96K49
  ENST ID: ENST00000283206
  CDS Start-End: 370-2037
gcgctcgggctgccagccctcccttgcacgttccggctcctcttctatcttcacgcccacgctaggccctgagcccagcctccacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtccgagccccgcgtcccggattcggacccgcctgcctggggcggtgctgcaccaggtgcgggtgtggcaggcgtctcggagcgccaggtgcagcttcctggtcaagatggtcgccgcctgccgctcggtagccgggctcctgccacgccgccgccgctgctttcccgcccgggccccgctgctgcgcgtcgccctctgcctcctgtgctggaccccggcggctgtgcgcgcggtccctgagctcgggctctggttagagacagtcaacgacaaatcaggacctttgatatttaggaaaactatgtttaactctacagatatcaagttatctgttaagtcattccattgttctgggcctgtgaagtttaccatagtgtggcatttgaagtatcatacctgtcacaatgagcattctaatctggaagagctgttccaaaaacataaacttagtgttgatgaagacttttgtcattatttgaagaatgacaactgttggacaacaaaaaatgaaaacttagattgcaacagtgattcacaggtgtttccctctttgaataataaagaactaataaatatcagaaatgtttcaaaccaggaaagatcaatggatgttgtagccagaacacaaaaagatgggtttcatatctttattgtttctattaaaacggagaatacagatgcaagctggaatttgaatgtttctctttctatgattgggcctcatggatatatctctgcatcagattggcccctaatgattttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaacccaaggcttattgatatttgcggagttgatttctgcgattaagaggacgttggctcgccttctcgtgatcattgtgagcctgggctatggcattgtgaagcctcgtttaggaacagtcatgcaccgggtgatcggactggggcttctatacttaatctttgcagctgttgaaggcgtgatgagagtcattgggggttctaaccatttagctgttgttcttgatgacattattttagcagttattgactccatttttgtgtggttcatttttattagtttggcacaaactatgaagaccctaaggctaagaaagaacactgtgaaattttcattatatagacattttaaaaatactctgatctttgctgtgctggcttctatagtgtttatggggtggacaactaagacatttagaattgcaaaatgccaatcagattggatggaacgctgggttgacgatgcattttggagcttccttttttcgcttatccttattgtaatcatgtttttgtggagaccatcagcaaacaatcagagatatgccttcatgcccttaatagatgattctgatgatgaaattgaggaattcatggtaacttctgaaaatttaaccgaaggaataaaattaagagcctcaaaatcagtttccaatggaacagctaagcctgccacttctgagaactttgatgaagatttgaagtgggtagaagaaaatattccctcttcattcacagatgtagctcttccagtgttagtggattcagatgaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctaccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatctggtagagtgggagtgtggagttaatggtgagtatgttaataaagggaaactgtctctgacagaatctcagtaatgtttaccaaaacatgtctttctacagctggtaggataaatgatgctaccctgtagctcagctacaggctgcagtgcaaacttttcttccatccagagaaagcagaattccctcctagtaacctcattacaaatactgttactagaagggcatgtgctgtctgtcaccttcagtaatatttgtgccatctcttgatgactgatgacctggatcgagtatttctatgaagggtcttcttaggccccttacatacgcaagaggggtgctctagtgccatagctgtagttcacaggaaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaatgat

SEQ ID NO: 194388 - DNA, 552 bp, Homo sapiens
  Payload ID: 18415
  Gene Name: transmembrane protein 87B
  ENST ID: ENST00000452614
  CDS Start-End: 1-552
ccctgagctcgggctctggttagagacagtcaacgacaaatcaggacctttgatatttaggaaaactatgtttaactctacagatatcaagttatctgttaagtcattccattgttctgggcctgtgaagtttaccatagtgtggcatttgaagtatcatacctgtcacaatgagcattctaatctggaagagctgttccaaaaacataaacttagtgttgatgaagacttttgtcattatttgaagaatgacaactgttggacaacaaaaaatgaaaacttagattgcaacagtgattcacaggtgtttccctctttgaatgatgttgtagccagaacacaaaaagatgggtttcatatctttattgtttctattaaaacggagaatacagatgcaagctggaatttgaatgtttctctttctatgattgggcctcatggatatatctctgcatcagattggcccctaatgattttttacatggtgatgtgtattgtttatatattatatggcatactctggctgacgtggtctgcctgttattggaaaga

SEQ ID NO: 194389 - DNA, 461 bp, Homo sapiens
  Payload ID: 18415
  Gene Name: transmembrane protein 87B
  ENST ID: ENST00000452029
  CDS Start-End: 1-337
ccctgagctcgggctctggttagagacagtcaacgacaaatcaggacctttgatatttaggaaaactatgtttaactctacagatatcaagttatctgttaagtcattccattgttctgggcctgtgaagtttaccatagtgtggcatttgaagtatcatacctgtcacaatgagcattctaatctggaagagctgttccaaaaacataaacttagtgttgatgaagacttttgtcattatttgaagaatgacaactgttggacaacaaaaaatgaaaacttagattgcaacagtgattcacaggtgtttccctctttgaattttctctttctatgattgggcctcatggatatatctctgcatcagattggcccctaatgattttttacatggtgatgtgtattgtttatatattatatggcatactctggctgacgtggtctgcctgttattggaaaga

SEQ ID NO: 194390 - DNA, 875 bp, Homo sapiens
  Payload ID: 18416
  Gene Name: transmembrane protein 88
  Uniprot ID: Q6PEY1
  ENST ID: ENST00000301599
  CDS Start-End: 11-490
caggcgggccatggcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcagttcctgcgctcccaggcacccccttgcaccgcgcacctgcgggaccccggtttcacggccctactggtcaccggattcctgctcctcgtgccgctgctcgtgcttgctctggccagctaccgccgcctctgcctgcgcctccgcctagccgattgcctcgtgccctacagccgagccctttatcggcgtcggcgcgccccgcagccgcggcaaatccgggcctcaccagggtcccaggccgttcccacatcaggaaaggtctgggtctaatgaccctcgagtcaagaacaaccctgacggctgccctccctcttattcggcccaaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaaggagtgtccacgcatcaataaagatttaacgaactgaa

SEQ ID NO: 194391 - DNA, 510 bp, Homo sapiens
  Payload ID: 18416
  Gene Name: transmembrane protein 88
  ENST ID: ENST00000574668
  CDS Start-End: 10-390
aggcgggccatggcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaa

SEQ ID NO: 194392 - DNA, 492 bp, Homo sapiens
  Payload ID: 18417
  Gene Name: transmembrane protein 88B
  Uniprot ID: A6NKF7
  ENST ID: ENST00000378821
  CDS Start-End: 1-492
atgagtgagcaggggagggagacggaggaggaggaggggggaggtggtgcttccgacacagcgcccatgctgccccggggacctcccgaccaccaggcctcagccctgacgtgcccagggtggtcggggcccccgctgctgcccggccggctgctggccgggctcctgctgcacctcctgctgcccgccgcagccttcctgctggtgctcctgcccgcggccgccgtcgtctacctgggattcctgtgccactcgagggtccaccccgctccgggtccccggtgccgcgcgctgttctcagaccgcggctccgcggcgctcatcgtgttcgggcttctctcgctgccgccgctgctggtgctcgcctcggccgtccgcgcccgcctagcccggcgcctccgcccgctgctgcctccgcccgctgggacccccggaccccgccgccccccggggcgccccgacgaggacgagcaactctgcgcctgggtgtga

SEQ ID NO: 194393 - DNA, 662 bp, Homo sapiens
  Payload ID: 18418
  Gene Name: transmembrane protein 89
  Uniprot ID: A2RUT3
  ENST ID: ENST00000330862
  CDS Start-End: 100-579
ggctggaacctgctgccttagagccaggcctcttcccgggggaggggcgtttgcccgttgccaggtgcccgggttccggccctggcactagcgacggccatgctgcatgtgctggcctcgctgcctttgctgctcctgctggtgacgtctgcctccacccacgcctggtcgagacccctctggtaccaggtggggctggacttgcagccctgggggtgtcagccaaagagtgtggagggctgtaggggtggcctgagctgtcctggctactggctgggccctggagcaagccgcatctaccccgtggctgcggtcatgatcaccaccacgatgctgatgatctgccgcaagatactgcaggggcggcggcgctcacaggccaccaagggtgagcatccgcaggtgaccactgagccctgcggaccctggaaacggcgggccccaatctcagaccacaccctgctccgtggggtcctgcacatgctggatgccctcctggtccacatcgaaggccacctacgtcatctagccacccagcggcaaatccaaataaaggggacttccacccagagtgggtgaccgaacatgtgcctctctttgcctgacagcctgaggtcctgggccaggtctgctctttccaggcctgtctggaccgtgtgtcc

SEQ ID NO: 194394 - DNA, 2346 bp, Homo sapiens
  Payload ID: 18419
  Gene Name: transmembrane protein 8A
  ENST ID: ENST00000250930
  CDS Start-End: 487-2223
agtgcccggggcgacggcggcggggaccggccgggccatgggcgccgggggcagaggcggaggcggcagaggctgtccttctacagctggtacggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccatccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccc

SEQ ID NO: 194395 - DNA, 844 bp, Homo sapiens
  Payload ID: 18419
  Gene Name: transmembrane protein 8A
  ENST ID: ENST00000424078
  CDS Start-End: 1-719
acctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctc

SEQ ID NO: 194396 - DNA, 3691 bp, Homo sapiens
  Payload ID: 18419
  Gene Name: transmembrane protein 8A
  Uniprot ID: Q9HCN3
  ENST ID: ENST00000431232
  CDS Start-End: 162-2477
cggaagtgcccggggcgacggcggcggggaccggccgggccatgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcgcaggccccgcagaggctgtccttctacagctggtacggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccatccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatatatatatggggttttttggagtaaaggaaaattctaagatattaagacatatttttatgtagatctgatctatctgtgtttggtgaatttaatattctacattgatttttcaaactaaacgagtttttacattt

SEQ ID NO: 194397 - DNA, 858 bp, Homo sapiens
  Payload ID: 18419
  Gene Name: transmembrane protein 8A
  ENST ID: ENST00000448854
  CDS Start-End: 1-732
cgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggtaaggagccgggctggctggcactgctgcccaggtgctcggagaagagagcctggccccttgctctagccacgttcctggtcctgctccaaccagtgaatgcccatatctgctgggggttgccatggcacccacagaggcccagcatggctgtgtccctgaggcctgggcctgaggaccagtggccttgagccc

SEQ ID NO: 194398 - DNA, 587 bp, Homo sapiens
  Payload ID: 18419
  Gene Name: transmembrane protein 8A
  ENST ID: ENST00000427313
  CDS Start-End: 525-587
aaacttgatgacagcatagtggccaagcttgtttctcctgggggtgctcttccaaggatattcaggccgcctccggcgtcgcagtgtcttgggccgctggaagaagagtctctccattgccaacactctgtgacttagcagacgtctctggacttccgtctggggattcttacccaccttcaagttcaccagccctcagctggagcactggaagtgggggctctgccgcttctctccctctccggcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtcttt

SEQ ID NO: 194399 - DNA, 3731 bp, Homo sapiens
  Payload ID: 18420
  Gene Name: transmembrane protein 8B
  Uniprot ID: A6NDV4
  ENST ID: ENST00000377988
  CDS Start-End: 1307-2725
gcccccagccccgccctcgccccgcttcccacatcggccccagcccctgcctgggtccccatccaggacccccttccagtctctgcccctggcctggcccccatcccggcctcggccctcgttccaccccctgtcacaaatcccagcccaggccctgtcccagccccattcccagtgtttgcttaaggccctggctcaaccccgtcccttgctgcagtccccatcacagcccttccttccatcccactccctgcccttgttcaagccccagtgtccagcccagcccaacccattatctcagcctttgccctcatctctgtgtttacccaagtctctccctctagtcccccctatctctcatactctgcccctctcccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagccccc

SEQ ID NO: 194400 - DNA, 3441 bp, Homo sapiens
  Payload ID: 18420
  Gene Name: transmembrane protein 8B
  Uniprot ID: A6NDV4
  ENST ID: ENST00000377991
  CDS Start-End: 1016-2434
cgacgtcaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagccccca

SEQ ID NO: 194401 - DNA, 2473 bp, Homo sapiens
  Payload ID: 18420
  Gene Name: transmembrane protein 8B
  Uniprot ID: A6NDV4
  ENST ID: ENST00000377996
  CDS Start-End: 1416-2432
ttgcatcacgttgggggagaacgggacggaatgaattctctgacctccgagccgcttctggcaagtgcagaagagaggttaacactagtgctcattaggaggccagaagcctgaggagggcagagcactggctccaagaagagaaagctcatttcctgcagggggcatcgggccagctgggctgcaggcagtggaaagaaggcggcagccgctgcactgaccctgtcccgacctcggcgccccggcctgcgcagggcgggaatcagcaccagctcgttctccggagccaccagttcgacctcaccacacagccccggagcttgtgcctcggaggggcagaggccacaggcaggagctctgcgcggctctgcgcgccttcgggaccccctggccccggatggcttcggagcccgcaggaccccctactcgctcccgcgccacttctcacctgccccccgcgcacccccgtggccgccacggctctgcgcgccgcgcgcaacccagcagccagcaccacggctgccgccatcttccctgagccgcgggaacctctcacccgggtcagcactcggctccgcggccggccgtgggtggggactccgggcgcggggaagcggggtagtggcggccgggcgagccctgctaccccattggagcgcgcctctgagcacgattcaccccattgcctctgcagccactttggaggcgggctcttttcatctcattggctgcttctaccaacgcgaggacaattttccattccattggtttcgtcttctagtccgtgtgaacgttcttttcccattggatccccttactagtttctctgtgagagaaacttccactccattggaaggattaatggagcctggagagacggggtttcaccgtgttagccaggatggtctcgatctcctgacctcgtgatcctcctgcctcggcctcccaaggtgctgggattacagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcc

SEQ ID NO: 194402 - DNA, 2150 bp, Homo sapiens
  Payload ID: 18420
  Gene Name: transmembrane protein 8B
  Uniprot ID: A6NDV4
  ENST ID: ENST00000439587
  CDS Start-End: 1092-2108
acgccgacgtcaagtcgaggccgccgccgcggggcctggttatcgccggttcagcgcagcccggagtcgcccaggcctgaactcctacccaggtccccggcccccgccccgggcccgcgaggacaccggaggccaccccccgggggtggggagcggagccgcggcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcca

SEQ ID NO: 194403 - DNA, 818 bp, Homo sapiens
  Payload ID: 18421
  Gene Name: transmembrane protein 8C
  Uniprot ID: A6NI61
  ENST ID: ENST00000339996
  CDS Start-End: 103-768
gccctgcccaaagggagctggccttcccacttcgtgctcctgtgctggggacctgggacaccagcaccctccccaccccagccagtgctttcctcctggcccatggggacgctggtggccaagctgctcctgcccaccctcagcagcctggccttcctccccactgtcagcatcgcggccaagaggcggttccacatggaggccatggtctacctcttcaccctgttcttcgtggcgctccaccatgcctgcaatggacccggcttgtctgtgctgtgcttcatgcgtcacgacatcctggagtatttcagtgtctacgggacagccctgagcatgtgggtctcgctgatggcactggccgacttcgacgaacccaagaggtcaacatttgtgatgttcggcgtcctgaccattgctgtgcggatctaccatgaccgatggggctacggggtgtactcgggccccatcggcacagccatcctcatcatcgcggcaaagtggctacagaagatgaaggagaagaagggcctgtacccagacaagagcgtctacacccagcagataggccccggcctctgcttcggggcgctggccctgatgctacgcttcttctttgaggactgggactacacttatgtccacagcttctaccactgtgccctggctatgtcctttgttctgctgctgcccaaggtcaacaagaaggctggatccccggggaccccggccaagctggactgctccaccctgtgctgtgcttgtgtctgatgctgcgcccagcccggctctgagcccctgccctccccagctcacacttg

SEQ ID NO: 194404 - DNA, 1959 bp, Homo sapiens
  Payload ID: 18422
  Gene Name: transmembrane protein 9
  Uniprot ID: Q9P0T7
  ENST ID: ENST00000367330
  CDS Start-End: 518-1069
gtggacgcggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtggctggcggagagccggagagttgggcgggagggaagcagggtttggcgaccaggtttagcaggccttggaatcctggagcccagcccccaaccccattcccacttggccggatggttaagggcctagcgtgctggctgcggtgtggccaccttccccttctccgactccgtatctctttttccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 194405 - DNA, 1544 bp, Homo sapiens
  Payload ID: 18422
  Gene Name: transmembrane protein 9
  ENST ID: ENST00000367332
  CDS Start-End: 94-654
agaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaaggtgagggagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 194406 - DNA, 1564 bp, Homo sapiens
  Payload ID: 18422
  Gene Name: transmembrane protein 9
  Uniprot ID: Q9P0T7
  ENST ID: ENST00000367333
  CDS Start-End: 122-673
tgctaggctctgtcccacaatgcacccgagagcaggagctgaaagcctctaacacccacagatccctctatgactgcaatgtgaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 194407 - DNA, 1529 bp, Homo sapiens
  Payload ID: 18422
  Gene Name: transmembrane protein 9
  Uniprot ID: Q9P0T7
  ENST ID: ENST00000367334
  CDS Start-End: 87-638
aggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 194408 - DNA, 507 bp, Homo sapiens
  Payload ID: 18422
  Gene Name: transmembrane protein 9
  ENST ID: ENST00000435310
  CDS Start-End: 94-507
ggacgggggtcgcggggctattgggggtcccagtccggcttaagacctctgggcgtggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatg

SEQ ID NO: 194409 - DNA, 545 bp, Homo sapiens
  Payload ID: 18422
  Gene Name: transmembrane protein 9
  ENST ID: ENST00000414605
  CDS Start-End: 57-545
cggctgcagcgggcttgtaggtgtccggctttgctggcccagcaagcctgataagcatgaagctcttatctttggtggctgtggtcgggtgtttgctggtgcccccagctgaagccaacaaggtgagggaggtgagcctgcagcacctggtcacgaccacagtgcacggccaccctgtctacagggctgactcagagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatg

SEQ ID NO: 194410 - DNA, 487 bp, Homo sapiens
  Payload ID: 18422
  Gene Name: transmembrane protein 9
  ENST ID: ENST00000455367
  CDS Start-End: 35-487
gtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgccctgtctctctctgttgtagcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatcc

SEQ ID NO: 194411 - DNA, 1075 bp, Homo sapiens
  Payload ID: 18422
  Gene Name: transmembrane protein 9
  ENST ID: ENST00000497582
  CDS Start-End: 516-812
ggacgcggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtggctggcggagagccggagagttgggcgggagggaagcagggtttggcgaccaggtttagcaggccttggaatcctggagcccagcccccaaccccattcccacttggccggatggttaagggcctagcgtgctggctgcggtgtggccaccttccccttctccgactccgtatctctttttccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatgg

SEQ ID NO: 194412 - DNA, 938 bp, Homo sapiens
  Payload ID: 18422
  Gene Name: transmembrane protein 9
  Uniprot ID: Q9P0T7
  ENST ID: ENST00000485839
  CDS Start-End: 323-874
cggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaag

SEQ ID NO: 194413 - DNA, 454 bp, Homo sapiens
  Payload ID: 18423
  Gene Name: transmembrane protein 91
  ENST ID: ENST00000342187
  CDS Start-End: 87-454
gtggtttgtgatgcagtggggagtagggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaa

SEQ ID NO: 194414 - DNA, 944 bp, Homo sapiens
  Payload ID: 18423
  Gene Name: transmembrane protein 91
  Uniprot ID: Q6ZNR0
  ENST ID: ENST00000356385
  CDS Start-End: 62-481
gggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194415 - DNA, 1389 bp, Homo sapiens
  Payload ID: 18423
  Gene Name: transmembrane protein 91
  Uniprot ID: Q6ZNR0
  ENST ID: ENST00000392002
  CDS Start-End: 661-1179
gaatgtaaagcgtttaacacagggcttgggtacagtctgccctcaatgaaccaatgatgtacccctaggcaatttacctaacctcggcttgccagtttcctcccgcgtgaaacaggacaataaacgattatgcctcttagggttgtgctgaggaatacatgtgtatgtaagtttatttgcaaagcacttagaacagggcgcacggtccttgttgctgttattattattggctattattgcgcaaaggggaagggaggcggggccaagccaggaaggccctggagaatccggggtgccccctcctccggcagagcttgggcctgggctcacgaggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194416 - DNA, 721 bp, Homo sapiens
  Payload ID: 18423
  Gene Name: transmembrane protein 91
  Uniprot ID: Q6ZNR0
  ENST ID: ENST00000447302
  CDS Start-End: 152-535
ggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194417 - DNA, 864 bp, Homo sapiens
  Payload ID: 18423
  Gene Name: transmembrane protein 91
  Uniprot ID: Q6ZNR0
  ENST ID: ENST00000436170
  CDS Start-End: 307-678
ggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194418 - DNA, 650 bp, Homo sapiens
  Payload ID: 18423
  Gene Name: transmembrane protein 91
  Uniprot ID: Q6ZNR0
  ENST ID: ENST00000413014
  CDS Start-End: 70-471
ggctcgcgcctctcccaggacccgcctggctgcgagatatgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194419 - DNA, 725 bp, Homo sapiens
  Payload ID: 18423
  Gene Name: transmembrane protein 91
  Uniprot ID: Q6ZNR0
  ENST ID: ENST00000544232
  CDS Start-End: 145-546
tgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194420 - DNA, 450 bp, Homo sapiens
  Payload ID: 18423
  Gene Name: transmembrane protein 91
  ENST ID: ENST00000537354
  CDS Start-End: 108-450
gcaggcaggaggcttggggaccttccagggggatcgtaggacgagaagaagaatattctttctggttgtgttgcgtgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgcct

SEQ ID NO: 194421 - DNA, 1610 bp, Homo sapiens
  Payload ID: 18423
  Gene Name: transmembrane protein 91
  ENST ID: ENST00000542945
  CDS Start-End: 112-510
gcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagagccatatacctgaggcgggaaggtggaaggtagcccagagaacctgaactcaaatcctgagtctgccactctctgcaagattttttttgagtctcactttgtcgcccaggctggagtgcagtggtacaatctcggctcactgcaatctctgcctcttgggttcaagtgattctcctgccccagcctcctgagtagctgggattagaggcgcgcgctaccatgcctggctaatttttgaatttttaataaagacggggtttcaccacgttggccacgctggtctcgaactcctgacctcaagtgatcctcccatcttggcctcccaaagtgctgggattacaggcgtgagccacggtgcccagctctctgcaagattttgggcaagtcacttaacttccctgtgcctcactttcctcatctgtaaagtgggaataattgctacctctgggtcaatgtgagaatcaaatgagttagaatagtggcatataccattttaatgtttttatttattttttaaaatttattattattattattttttaccattttaatgtttttattaaccactcagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaa

SEQ ID NO: 194422 - DNA, 378 bp, Homo sapiens
  Payload ID: 18423
  Gene Name: transmembrane protein 91
  ENST ID: ENST00000546050
  CDS Start-End: 1-192
gagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194423 - DNA, 489 bp, Homo sapiens
  Payload ID: 18423
  Gene Name: transmembrane protein 91
  ENST ID: ENST00000546362
  CDS Start-End: 1-262
tcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatggacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgca

SEQ ID NO: 194424 - DNA, 1843 bp, Homo sapiens
  Payload ID: 18423
  Gene Name: transmembrane protein 91
  ENST ID: ENST00000539627
  CDS Start-End: 322-720
gagaggaagggttggagggtgatgcagagagggagaggcggggagatgtcagagacggagacgaggcaacaggaccgtggaggagaaaaatagaaagggagagaaaatagtcggagagacaaaaaccaggagacccatgcgtggacagaaagactaacggagacgaaaagaaagaggcagatggggagacacgtgcgagacgagacacatgtgcatttgttggggagaagaggattggaggtgtcagtgttaaaggaacctctacaacgaaggtgaagccacggaagataaggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaaggtcagtctgtgtgtgggacttggaggggactgggcataaaagagaaaaatgcaccacaaaaacaaagagccatatacctgaggcgggaaggtggaaggtagcccagagaacctgaactcaaatcctgagtctgccactctctgcaagattttttttgagtctcactttgtcgcccaggctggagtgcagtggtacaatctcggctcactgcaatctctgcctcttgggttcaagtgattctcctgccccagcctcctgagtagctgggattagaggcgcgcgctaccatgcctggctaatttttgaatttttaataaagacggggtttcaccacgttggccacgctggtctcgaactcctgacctcaagtgatcctcccatcttggcctcccaaagtgctgggattacaggcgtgagccacggtgcccagctctctgcaagattttgggcaagtcacttaacttccctgtgcctcactttcctcatctgtaaagtgggaataattgctacctctgggtcaatgtgagaatcaaatgagttagaatagtggcatataccattttaatgtttttatttattttttaaaatttattattattattattttttaccattttaatgtttttattaaccactcagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194425 - DNA, 400 bp, Homo sapiens
  Payload ID: 18423
  Gene Name: transmembrane protein 91
  ENST ID: ENST00000535712
  CDS Start-End: 1-181
ctgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatggttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 194426 - DNA, 757 bp, Homo sapiens
  Payload ID: 18423
  Gene Name: transmembrane protein 91
  ENST ID: ENST00000604123
  CDS Start-End: 6-578
tccagatgcgctgtggctttgcgggcggtgtgggtcaccagagaaagaggaccaggcggagaaggcttaatccgggggatgagacacaggggagccgaccagaggagggggacccagaacggaaggagagtcaggctgggaaacaaggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 194427 - DNA, 2767 bp, Homo sapiens
  Payload ID: 18424
  Gene Name: transmembrane protein 92
  Uniprot ID: Q6UXU6
  ENST ID: ENST00000300433
  CDS Start-End: 111-590
gtgtgatctcagctcactgcagccttgaactcctaggctcaagtgatcctcctacctcaacctccagagtaactgggactacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggacagtccatccatgggccgccctcggagagaggcttgttctagatgtattggctgtctgttttttgatgtctctgtgtgccaaacagcctggaaatggggtacgcgtgtcccttgtgtgggtttcccaatcccttccgcccaaggctttcctgggacacatggagcccagctctctggctgtcttaccatgagaagttggtaagttggctgtgagggggttggatccaggaagcagccctgggacagcccattctgctgttgatagcaggaaaccacctgctgggagacaatgggggtggggaaaagcccaggagagcagtgggtggggctgggcatccgtggagtggggctttaggagaccttgaacggccccaccctggaatctcctacaggaaggtgaggaggtggcaggttccacccttctctaccagccccgctcgctcgtgggagttaaccccctaggggagaagagtcttcactggggttcgacccatgggggcctggcatagtcatgcagaatggggcgggacaatgccaatgccttgggactcagacagggctgagtgcctccaccctgatttttgcctctgcactgcgcccccacagcccactcaatgccagcctccttctccaggcagagagccccatgtcaatgctggccaaagctctcaggaggattggaggtagaactggccctggtatgccaacaggggtgcctcttttagtgctctcccaataatgctcatcctgggggcatcaggacgcaggcaggtggcagagctgggggcagcttgatggcacaggcagccccaaagatgccaggaacagggactgtccgggtgtgggttcccagtgagatagggccctggaaggagtgcagcagttactgacaatatagtgccagggttggccataggagaatgagcccaagcgtaagtggaagtttccctttactttcagggattggtcaggggtggcagaaaacatgtgggttctttgtgtagatgtggctagttccaattagagaagtcctgcagctgatgttgccctcaccgtgatagcaggaggatgttgagaaatgggcttgggagacctggaggagaagttaccctcggcccagacgttgccttcctttcatcacagggcctttaactcctcctagggagtagcagagtggccctagggaaagtggccatcctgaaacctagtgttgctgtgacctggtgacagaaatggaaacctctgtggctcttctggtcatccttggtgggagtgggaatggtgtcacctttctagagggccatctggcaccatgtaatcacgccacagatctttacgaagctcctgctatgtaggaaacactatgcctggcactgggtatccattaaaatgtaaaatgcacgtgacctggcaattccacttctagaaatgagccttcagaagtgctcatacaaaagagctcaataagtatcatgcactaattcattgtgccaccagagctccctatgcagccttttaaaagaataaataggatctgtagcaccaa

SEQ ID NO: 194428 - DNA, 573 bp, Homo sapiens
  Payload ID: 18424
  Gene Name: transmembrane protein 92
  Uniprot ID: Q6UXU6
  ENST ID: ENST00000507382
  CDS Start-End: 76-555
ataggtggagagaagtgggagaggtcgcagccccgccttctctacacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaa

SEQ ID NO: 194429 - DNA, 5213 bp, Homo sapiens
  Payload ID: 18425
  Gene Name: transmembrane protein 94
  Uniprot ID: Q12767
  ENST ID: ENST00000314256
  CDS Start-End: 395-4465
actcggcacctaattccgccaggctcccagaggggcggttgcagctacagcctagcacgccgcgtagccaataagaagccagaattccccctattctcaaatcctgaccaatcggtggcctgaactttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgct

SEQ ID NO: 194430 - DNA, 4703 bp, Homo sapiens
  Payload ID: 18425
  Gene Name: transmembrane protein 94
  ENST ID: ENST00000375248
  CDS Start-End: 193-4293
gaattaatcagcagattgaagctctgctctgctgcgcctgattctgtgcagcacccggcttcttgctcacacactctcagctgtctccgtctcttctctcctcttctctctctctctcttttcaccctccccgctttgagggaggtgttggaagttcttgcagctgactgcttgtggctcagactctggcccatgctctttaagcaggcagagctatggatgccccatcagggcaaaggcaacaaaggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctaccccctttagggatcccttgcccccttggagatcccttgccccccagtgcctctgctcgtgggtccctggacacggccttgaagccaaccttctttggaggagcaaca

SEQ ID NO: 194431 - DNA, 384 bp, Homo sapiens
  Payload ID: 18425
  Gene Name: transmembrane protein 94
  ENST ID: ENST00000577245
  CDS Start-End: 1-384
ccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtg

SEQ ID NO: 194432 - DNA, 564 bp, Homo sapiens
  Payload ID: 18425
  Gene Name: transmembrane protein 94
  ENST ID: ENST00000582455
  CDS Start-End: 393-564
agtaacggacatggctgcggcccccggaggaggggacgtgaagtgaggagggggttgggaggggagaggacgcgggcgaggaagaccagccccggggccccgaagcgttttcaggctcctcggaagctcaccatccatgccatcggataaagtgactcctgtggaatgccctcgttcctgtaccgcacacccctggagcccaggtctcctggttcctagcatgccacgatgcggcccctgcccgctgcccagcgccagatgcaagcaaagccccgctctttcattgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccacc

SEQ ID NO: 194433 - DNA, 566 bp, Homo sapiens
  Payload ID: 18425
  Gene Name: transmembrane protein 94
  ENST ID: ENST00000579707
  CDS Start-End: 1-489
atgctctttaagcaggcagagctatggatgccccatcagggcaaaggcaacaaaggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagcctcttctcttcctcctcattctgatgctgaaactactcaccagtcctaggcccactgtgtatcagcctctgcctctgtgcctctctccactgttctctgctgatgccctcagggatggcagggaga

SEQ ID NO: 194434 - DNA, 565 bp, Homo sapiens
  Payload ID: 18425
  Gene Name: transmembrane protein 94
  ENST ID: ENST00000582186
  CDS Start-End: 460-565
agagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctggtaggccatatcctattaccttatagggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttc

SEQ ID NO: 194435 - DNA, 528 bp, Homo sapiens
  Payload ID: 18425
  Gene Name: transmembrane protein 94
  ENST ID: ENST00000584694
  CDS Start-End: 1-528
gtggctgtcctgcttttgctaccctctgctcagcatctctctgctggggaagcccccccatagctccatcatgtctatggcaacggggaaaaacctccagtccattcccaagaagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctaca

SEQ ID NO: 194436 - DNA, 905 bp, Homo sapiens
  Payload ID: 18425
  Gene Name: transmembrane protein 94
  ENST ID: ENST00000578853
  CDS Start-End: 1-905
cgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagccca

SEQ ID NO: 194437 - DNA, 545 bp, Homo sapiens
  Payload ID: 18425
  Gene Name: transmembrane protein 94
  ENST ID: ENST00000581519
  CDS Start-End: 171-545
cataaagcctttaagtccattcctggtgttcaagtgagaaggttctgggtcaggcgtggcactgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagag

SEQ ID NO: 194438 - DNA, 3543 bp, Homo sapiens
  Payload ID: 18425
  Gene Name: transmembrane protein 94
  ENST ID: ENST00000579208
  CDS Start-End: 209-3232
agtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatgatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagaggggccctaaaccccctcacctgtgagctacccccttta

SEQ ID NO: 194439 - DNA, 522 bp, Homo sapiens
  Payload ID: 18425
  Gene Name: transmembrane protein 94
  ENST ID: ENST00000581252
  CDS Start-End: 257-522
agtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgg

SEQ ID NO: 194440 - DNA, 570 bp, Homo sapiens
  Payload ID: 18425
  Gene Name: transmembrane protein 94
  ENST ID: ENST00000582843
  CDS Start-End: 1-220
acgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagctcctgccagtgtcatgagatatattaatagtccatagaagcagacaggagcccaagaaggacaggaagcggatttcaggagggagcgggtggaagaggacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgct

SEQ ID NO: 194441 - DNA, 922 bp, Homo sapiens
  Payload ID: 18425
  Gene Name: transmembrane protein 94
  ENST ID: ENST00000577247
  CDS Start-End: 1-888
tacgccaccagcatcagcatggcccaggcctcggatggcctttctcccctgcagctgtcagggcagctcaacagcctgccctgttccctgacctttcgccaggaggagaccatcagcatcatccggcttatcgaacagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtc

SEQ ID NO: 194442 - DNA, 554 bp, Homo sapiens
  Payload ID: 18425
  Gene Name: transmembrane protein 94
  ENST ID: ENST00000577380
  CDS Start-End: 192-554
attctgatcctgaaaatgtcctggagaagggcattctggctgtgggaatagctgctgcaaaggtcctgaagaaggaatgcaccagatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgt

SEQ ID NO: 194443 - DNA, 513 bp, Homo sapiens
  Payload ID: 18425
  Gene Name: transmembrane protein 94
  ENST ID: ENST00000580441
  CDS Start-End: 1-169
actgcttctcaaccttgtgctcatcgggcggcaagaccggctgaagcgtcgggaggtagagcggaggctgcgagggatcattgaccaaatccaagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcg

SEQ ID NO: 194444 - DNA, 769 bp, Homo sapiens
  Payload ID: 18425
  Gene Name: transmembrane protein 94
  ENST ID: ENST00000580918
  CDS Start-End: 1-769
gaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgaggtagaggaggagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacatcgccctgcaagagagccacagcgccgtgctgcccgtccatgtgccctggg

SEQ ID NO: 194445 - DNA, 1169 bp, Homo sapiens
  Payload ID: 18426
  Gene Name: transmembrane protein 95
  Uniprot ID: Q3KNT9
  ENST ID: ENST00000330767
  CDS Start-End: 28-582
gcgccgccccatcccccagtggtcctcatgtggaggctggcactaggcggggttttcctggcagccgcccaggcttgtgtcttctgtcgcctcccagcccacgacttgtcaggccgcctggctcggctctgcagccagatggaggccaggcagaaggaatgtggggcctccccagacttctcggcctttgccttagatgaggtgtccatgaacaaagtcacagagaagactcacagagtcctgagggtcatggaaatcaaagaggctgtctcctcactcccttcatattggagttggcttcgaaagaccaagctccctgagtacaccagggaagctctctgtccccccgcctgcccgttgcctctgctgtctcctgcagggggcagcaccacgctgtacaactgctccacctgcaaggggacggaggtgtcctgctggccccgaaagcgctgcttcccaggaagtcaggatctttgggaagccaagattctgctcctctccatcttcggagctttcctgcttctgggtgttctgagcctcctggtggagtcccaccacctccaagcaaaaagtggcttgtgaagacgctgaaaacctcccagcctccagctctaaggggtatgcactcacaacttccacatcccttggaggggaaccagtcagccccttagtcccagctccaaagacagtctccagaccctaaaacccagacatccctgcttctggttggtgagataatgaaaaacaagaaaatccccaaaaacccagatcccccacaatcccagtgtcagatggcctcccgggaacccaggcacccacagctggaaagttcctcccctccagccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatggc

SEQ ID NO: 194446 - DNA, 1191 bp, Homo sapiens
  Payload ID: 18426
  Gene Name: transmembrane protein 95
  Uniprot ID: Q3KNT9
  ENST ID: ENST00000389982
  CDS Start-End: 83-694
tccaggcaagggctggagccagggctgcagagcattcctcggctcagctggggcagcgccgccccatcccccagtggtcctcatgtggaggctggcactaggcggggttttcctggcagccgcccaggcttgtgtcttctgtcgcctcccagcccacgacttgtcaggccgcctggctcggctctgcagccagatggaggccaggcagaaggaatgtggggcctccccagacttctcggcctttgccttagatgaggtgtccatgaacaaagtcacagagaagactcacagagtcctgagggtcatggaaatcaaagaggctgtctcctcactcccttcatattggagttggcttcgaaagaccaagctccctgagtacaccagggaagctctctgtccccccgcctgccggggcagcaccacgctgtacaactgctccacctgcaaggggacggaggtgtcctgctggccccgaaagcgctgcttcccaggatctttgggaagccaagattctgctcctctccatcttcggagctttcctgcttctgggtgttctgagcctcctggtggagtcccaccacctccaagcaaaaagtggcttgtgaagacgctgaaaacctcccagcctccagctctaaggggtatgcactcacaacttccacatcccttggaggggaaccagtcagccccttagtcccagctccaaagacagtctccagaccctaaaacccagacatccctgcttctggttggtgagataatgaaaaacaagaaaatccccaaaaacccagatcccccacaatcccagtgtcagatggcctcccgggaacccaggcacccacagctggaaagttcctcccctccagccctcaaccaatcacatggctgtcaacaatgccaggaaaatatctacagaaggaaagaatcccctacgccactcccaccacacccacacccccttctgcctgttccgggaaagcgggggcatctgccccagaagctattccaggccctcctatgactgatggggaatccgggaatgcatgttctggaaaactcaccccactagagtgagatcacatcagtgggttcgcgggcatgccctccctccatcgtgttaacagtttgaaatcctggcctccctcagaggcctccatcctgccaggcctaagtaaaacttgctgttcatgg

SEQ ID NO: 194447 - DNA, 622 bp, Homo sapiens
  Payload ID: 18426
  Gene Name: transmembrane protein 95
  Uniprot ID: Q3KNT9
  ENST ID: ENST00000576060
  CDS Start-End: 28-558
gcgccgccccatcccccagtggtcctcatgtggaggctggcactaggcggggttttcctggcagccgcccaggcttgtgtcttctgtcgcctcccagcccacgacttgtcaggccgcctggctcggctctgcagccagatggaggccaggcagaaggaatgtggggcctccccagacttctcggcctttgccttagatgaggtgtccatgaacaaagtcacagagaagactcacagagtcctgagggtcatggaaatcaaagaggctgtctcctcactcccttcatattggagttggcttcgaaagaccaagctccctgagtacaccagggaagctctctgtccccccgcctgccggggcagcaccacgctgtacaactgctccacctgcaaggggacggaggtgtcctgctggccccgaaagcgctgcttcccaggaagtcaggatctttgggaagccaagattctgctcctctccatcttcggagctttcctgcttctgggtgttctgagcctcctggtggagtcccaccacctccaagcaaaaagtggcttgtgaagacgctgaaaacctcccagcctccagctctaaggggtatgcactcacaacttccacatccctt

SEQ ID NO: 194448 - DNA, 2568 bp, Homo sapiens
  Payload ID: 18427
  Gene Name: transmembrane protein 97
  Uniprot ID: Q5BJF2
  ENST ID: ENST00000226230
  CDS Start-End: 146-676
gagcctcctcttctcgccagccaatggaagcggtctgcctagccctcgcgggggcaaggcggcgaccgaggcgcgtgggtctgggaaggcgcgcggatttggcccctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccactgcctggtttgttttgtggactaggggatagagaatccagggttctctcatgaggagttaaacatatttcaagagcaacaggaaaaaaggtacatcaagccatttgaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattca

SEQ ID NO: 194449 - DNA, 493 bp, Homo sapiens
  Payload ID: 18427
  Gene Name: transmembrane protein 97
  ENST ID: ENST00000582113
  CDS Start-End: 35-313
tcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggttggtaaatggtgggaaaatcccatttttactcagaaatcaggtcccagaaatcttttgggaaagtatctccaaagggaaggggatggtccccatagtttgtgggagaatgctacaggatctggggtaaatagccagggtagatcttgtaaagggacattagtgtggctcaggctcatgtctgtggt

SEQ ID NO: 194450 - DNA, 1075 bp, Homo sapiens
  Payload ID: 18427
  Gene Name: transmembrane protein 97
  ENST ID: ENST00000582384
  CDS Start-End: 1-357
ggagtggctgctgggcctctacttcctcagccacatccccatcaccctgttcatggacctgcaggcggtgctgccgcgcgagctctacccagtcgaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgatt

SEQ ID NO: 194451 - DNA, 578 bp, Homo sapiens
  Payload ID: 18427
  Gene Name: transmembrane protein 97
  ENST ID: ENST00000583381
  CDS Start-End: 287-496
cttctcacatcagcgggtccaggcccaaccgacagactatgggggctccggcaaccaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaac

SEQ ID NO: 194452 - DNA, 2115 bp, Homo sapiens
  Payload ID: 18427
  Gene Name: transmembrane protein 97
  ENST ID: ENST00000336687
  CDS Start-End: 474-683
gggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgtcagcatggatccgcatcctttttatttgacaagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgacca

SEQ ID NO: 194453 - DNA, 826 bp, Homo sapiens
  Payload ID: 18428
  Gene Name: transmembrane protein 98
  ENST ID: ENST00000261713
  CDS Start-End: 222-826
ggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcagga

SEQ ID NO: 194454 - DNA, 1683 bp, Homo sapiens
  Payload ID: 18428
  Gene Name: transmembrane protein 98
  Uniprot ID: Q9Y2Y6
  ENST ID: ENST00000394642
  CDS Start-End: 383-1063
cccggggcggggcgcaggcagggaccctccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccact

SEQ ID NO: 194455 - DNA, 808 bp, Homo sapiens
  Payload ID: 18428
  Gene Name: transmembrane protein 98
  ENST ID: ENST00000395149
  CDS Start-End: 396-808
tggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcaggtaagacccacctgtcccactctctttcgtggcttcttgaccagatctgctctgacttcatgttctctcaagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccag

SEQ ID NO: 194456 - DNA, 896 bp, Homo sapiens
  Payload ID: 18428
  Gene Name: transmembrane protein 98
  ENST ID: ENST00000439138
  CDS Start-End: 231-896
gggatgcgcccgggagccacagcctgagggtttaaaaagctattttaaggccgggctcggtgtctcacgcgtgtaatcccagcactttgggaggcccgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggag

SEQ ID NO: 194457 - DNA, 4434 bp, Homo sapiens
  Payload ID: 18428
  Gene Name: transmembrane protein 98
  Uniprot ID: Q9Y2Y6
  ENST ID: ENST00000579849
  CDS Start-End: 432-1112
tccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaagtgtgtagttattgagtcaaattcatatgcatggtgtattgtgggacatacttagatggaaggagagagcctaagaatcctgaggatgatttctgtgtatgcctcaaaatgagatatttaggctgggcgcggtggctcacacctgtaatcctcgcactttgggaggctaaggtgggtggattgcttgagcccaggagtttgagaccagcctgggcaacatggtgaaacctcatctctacacaaactacaaaaattagctgggcatggtgacacgtgcggctgcttggtaggctgaggtgggaggatcgcttgagcccaggaggtgaaggttgcagtgagccctgattgtgccactgcattccagcctgggcgacagagtgagaccatgtctccaaaacatacatatatataaaatatatttaaagacctcttggagttcaggcagaagtgaagatagcactatgaagtagtttccacattaacaatagcaatgacttgaacgatgtgttccccctttcttctgatattaatatctgttcattttgcaaacattgaaagattatgaaagctatgacccagaatcacaattatataatttggatacatacccaaatggcataatttctgtcataagcctgtaggaaaagcttgaattcttcacttctcagattctcagagccagcttgctcttgggagaggggcctggtataggggctgcccaggttcgtagcctatgctgtcaagcatgtttggagttgcacatctgttcccatgtcattttctctgtctaactgaagtcagaaaattcctcagctggattctggggaaccaggaacccatattcccaaatccaagattgggacctggtttgtctttccatttgggcacatttcattctttccaggaaaacaggccacttccaacctgcacaatgtacaccaaaccacagaaccacagctgggatatggagtcaggagagggaagctggagctcaactctcatggactaaaggatggattctggatgggctccaggggacaccttattggattggtggcttccatcaactcttaaaaacgttaagtggtgaactttcccgtcctgtcaagctgtgaatggggaatgtatacaaagtcactttgacttttctatttgaggcctccacagtaaacatccagagtcatcctatttttgtctttttacctccctttcagaacctgttttcgtaattagactggaaagcaattcatgctaagtttgcaatggctgccacagttgtaagtgtcccctgcattttaacctgcactagagccctaagccacagagaagcagttctgaattggtatctcaaataccatccacctggtgtgggtctgcagggtggagagctttcccagcacccctgaagcaatgcccaatgtcgattaccttctctgagtcctggcaagtcctggcacattggctttctggatcccttagatgctgccctttctgttgtgaggagaggttgccgaagatattggaggtgtctgctggactgtaggatttctgatcccactgctgtgtagtttttttttctagtgctggacaagtaagaagcctctggataaatttggtgttggtggctgatggttgaagtggaagcagtctttggggtaggaggcaatgccactcctctaggcccttcgggagttggctgaagttacttcctcccttggaaggggctggttagtgagtgccagggatctcaggactgtctctgtgccaggtgtggtttcccaggcaacagacacattcctaagtgcctagttctctagcgtctgtatacatggtagtagagccttccttccatgtctctcttccctctggcctggaataggagcattagactcaaattctgatgaaaaagaaattacttggagatagagattcaatgtgaagagaacaagatatttgaagtcagaattaggtttgaatttgggctcagtgacttacagtgtgagcttggtcaagttcttaacattctggtccttagcattctcatctgtatggtcaaggctattgtcattgggttggtatgtcaacaagcaaaacggtatgtgtgagctgcccaattgtgggcctggttctgattagccaatgttaacacccttctctccacagcttcccattctctgatgccgctgacccagatggcgtcacctcagttaccatggcttggtccaagcagtgacttctgttcatgggctctggaattgagtggccaaaaatctggaatccctacagtagggagagtagccttgtccctgccccactacaagtctgttcatatgaagacatacaaagccgtcgcctctaatcagtgttcaaagggtcgattgtgcaactcacattcctccagagaaattcccccagcttgtgagatctccaagagggaacacgtattcctggcatccaacttcccctggtgctccccctgacctgcctcattccaggagttccctctccagagaccctgtgtgcccacacgagcagacttttagaaaatggcctacagttcaaaggccctgcattgctttatggccttggaaatgtggggaaagtgtcagatgaagaatttctatcctcctcacctcctccctgtctccaataaatgcataccaaga

SEQ ID NO: 194458 - DNA, 776 bp, Homo sapiens
  Payload ID: 18428
  Gene Name: transmembrane protein 98
  ENST ID: ENST00000583437
  CDS Start-End: 496-776
ctctactaaaaatacaaaaaattagccgggtgtggtgtcaggcacctgtaatcctagctacttgggaggctgaggcaggagaatcgcttgaacccaggaggcagaggttgcagtgagctgagatcgtgccattgcactccagcctgggtgacagagctagactccatcttaaaaaaacaaacaaacacaaacaaacaaacaaaaaattttagtccaactggggagcaaattcttctgagaaaggaaaaggcaaatttggggcatggcataaattttaccttggttctcttcaggccctcaggtctctgcaggtgtcgtggaggaacctagcacctgccatcctcttccccaatttgccacttccagcaggtaagacccacctgtcccactctctttcgtggcttcttgaccagatctgctctgacttcatgttctctcaagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactg

SEQ ID NO: 194459 - DNA, 806 bp, Homo sapiens
  Payload ID: 18428
  Gene Name: transmembrane protein 98
  ENST ID: ENST00000578289
  CDS Start-End: 165-581
agtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccaggtaaggagaccaaagcagaaagatcagtaaccctcctggagtctcacaattaatatgaatcagagcaggatcttcaactcctcaacttgtgtttttaactggcacatcttcctgcctgggtgcagcaggtgggaaatccatcatggaaaggaaagaacagacatgagagtcattccattctcttccagttcaaatctttttttgtgaaaaaaatggtagttgtgaccca

SEQ ID NO: 194460 - DNA, 2058 bp, Homo sapiens
  Payload ID: 18429
  Gene Name: transmembrane protein 99
  Uniprot ID: Q8N816
  ENST ID: ENST00000301665
  CDS Start-End: 305-1081
gccgaaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtgccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggtcatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttatactagttttcatgacttctgcttaatattgggtatttttttgttttgttttgttttggcggtgataggcttaccttacattaaaccaggccttagcctttctgtggctttgttatggcaaagcctcatattactctctagtctggttcagcaggacagtcaggtccacacctggggctgtttgttttctacgtttacctcaacataaggtaccttatcattgtcagccttcatctcctgatccaaaataaaataaaatgccacaggttacttgattttgcatctggaatatgattatttaaagaaattaaaaatttaaaactgaaaatgtagagtttagaaatcttttttaaggtttcaaaaaaatttctaggagacaacaaaatagtgttactagatttagcaaataaaatacagaatgccaattaaatttgaatttcaaatgaacattgaatactttttttggtataactatattccatgcaatatttgggacatatctgttatattattcattgtttacctgaaattataatttaaactgagagttctgtattttatctggcaaccttattatgaaaatatttaggatcaatataaaggaataatatttttaatttttacaaactattttaatataagtaatttatttgattttcattgtcatcctgagagttaagttttgccttacagtctatgttactttacctgtgttttatgaaaagactgtctcttataatgatagccaccaccaccatatcttgacaagtattgacatactgaaactttaaattcattttgtgtagttcccgcctcttcatgattgtttctgaggtaattcagcttctccgtctggctttccattttcaactctaggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtgaagacatgggttcaaattgcacctctgccatgttcagctgtcaccttgggcaaattacttctctgaaccttagttttctcatcattaaaatgggaatattggt

SEQ ID NO: 194461 - DNA, 854 bp, Homo sapiens
  Payload ID: 18429
  Gene Name: transmembrane protein 99
  Uniprot ID: Q8N816
  ENST ID: ENST00000436612
  CDS Start-End: 286-854
ttccgccgccgtagccgccgccgaaacttccgccgccgcgtccgccgcctccggaactaaacgggatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtgccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggtcatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatactta

SEQ ID NO: 194462 - DNA, 2073 bp, Homo sapiens
  Payload ID: 18429
  Gene Name: transmembrane protein 99
  Uniprot ID: Q8N816
  ENST ID: ENST00000622451
  CDS Start-End: 316-1092
ggttatctctaacgttggaaaacggtgggtagctttccagttgccgttaatttagaaaataagcaaaacgtgttgaaaaaataaaaccctgccagatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtgccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggtcatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttatactagttttcatgacttctgcttaatattgggtatttttttgttttgttttgttttggcggtgataggcttaccttacattaaaccaggccttagcctttctgtggctttgttatggcaaagcctcatattactctctagtctggttcagcaggacagtcaggtccacacctggggctgtttgttttctacgtttacctcaacataaggtaccttatcattgtcagccttcatctcctgatccaaaataaaataaaatgccacaggttacttgattttgcatctggaatatgattatttaaagaaattaaaaatttaaaactgaaaatgtagagtttagaaatcttttttaaggtttcaaaaaaatttctaggagacaacaaaatagtgttactagatttagcaaataaaatacagaatgccaattaaatttgaatttcaaatgaacattgaatactttttttggtataactatattccatgcaatatttgggacatatctgttatattattcattgtttacctgaaattataatttaaactgagagttctgtattttatctggcaaccttattatgaaaatatttaggatcaatataaaggaataatatttttaatttttacaaactattttaatataagtaatttatttgattttcattgtcatcctgagagttaagttttgccttacagtctatgttactttacctgtgttttatgaaaagactgtctcttataatgatagccaccaccaccatatcttgacaagtattgacatactgaaactttaaattcattttgtgtagttcccgcctcttcatgattgtttctgaggtaattcagcttctccgtctggctttccattttcaactctaggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtgaagacatgggttcaaattgcacctctgccatgttcagctgtcaccttgggcaaattacttctctgaaccttagttttctcatcattaaaatgggaatattggttttt

SEQ ID NO: 194463 - DNA, 2611 bp, Homo sapiens
  Payload ID: 18430
  Gene Name: transmembrane protein with EGF-like and two follistatin-like domains 1
  Uniprot ID: Q8IYR6
  ENST ID: ENST00000374879
  CDS Start-End: 433-1575
cggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcccgggagccgcgcgtccaaccagcccccgggtggtggcggcggcagcggcggggactgtcccggcggcaaaggcaagagcatcaactgctcagaattaaatgtgagggagtctgacgtaagagtttgtgatgagtcatcatgtaaatatggaggagtctgtaaagaagatggagatggtttgaaatgtgcatgccaatttcagtgccatacaaattatattcctgtctgtggatcaaatggggacacttatcaaaatgaatgctttctcagaagggctgcttgtaagcaccagaaagagataacagtaatagcaagaggaccatgctactctgataatggatctggatctggagaaggagaagaggaagggtcaggggcagaagttcacagaaaacactccaagtgtggaccctgcaaatataaagctgagtgtgatgaagatgcagaaaatgttgggtgtgtatgtaatatagattgcagtggatacagttttaatcctgtgtgtgcttctgatgggagttcctataacaatccctgttttgttcgagaagcatcttgtataaagcaagaacaaattgatataaggcatcttggtcattgcacagatacagatgacactagtttgttgggaaagaaagatgatggactacaatatcgaccagatgtgaaagatgctagtgatcaaagagaagatgtttatattggaaaccacatgccttgccctgaaaacctcaatggttactgcatccatggaaaatgtgaattcatctattctactcagaaggcttcttgtagatgtgaatctggctacactggacagcactgtgaaaagacagactttagtattctctatgtagtgccaagtaggcaaaagctcactcatgttcttattgcagcaattattggagctgtacagattgccatcatagtagcaattgtaatgtgcataacaagaaaatgccccaaaaacaatagaggacgtcgacagaagcaaaacctaggtcattttacttcagatacgtcatccagaatggtttaaactgatgacttttatatgtacactgaccatgtgatgtacatttattatgtctttttttaaagaatggaaatatttatttcagaggccttatttttggacatttttagtgtagtactgttggctcgtatttagaatattcagctacgacagttttggactgtttagtagtctttgttttatgtttttaaatacagaaattgctttcacaaatttgtaccacatggtaattctaagacttgttctttacccatggaatgtaatatttttgcaaagatggactacttcacaaatggttataaagtcatatccacttcttccacaatgaccacagcaaatgaccaagcatgaactaaaggtaaagatgtttacagattacttttcttacaaaaaaaatctagaagacactgtgtttaaatagatatttaaatgtttttgagatttagtaactgattttttagacactgcctatcgcatgaactgtaaagctgtgtgtattaggtgtaaaatatttataagatatatggactggggaatttgattattcctccctttgaaaaaatagtcctaataatttgaacaaatatgttagtaatgatggaacagatcaatgaaaagtagatatagatattgtgaaaataggctgtttaacaaacagattggaataaagcctattctaccagttaaactactttaatacacattcatttttaaagaaaatgtttgttttaacataaataaacaaatcgtatcagtgtttgtgaataaaatacaaaaatgattgttaatgattggtgctcttaaagtgagcttaaaatttatccaagacgtatatccaaatttgtcctgtagtaatagattaatattcatagattgttggtgtttaaagatctgaagtgtgagtagaatgtattcagctgtttaacatgtagtttagatattcaaaagtatgcatgtagaatttaaagaatatgttaaaaattattaattttaatattttgtttggaaaagcatgttataatataatgttttcactata

SEQ ID NO: 194464 - DNA, 2604 bp, Homo sapiens
  Payload ID: 18431
  Gene Name: transmembrane protein with EGF-like and two follistatin-like domains 2
  Uniprot ID: Q9UIK5
  ENST ID: ENST00000272771
  CDS Start-End: 1186-2310
aaacctgcgaacgcttgggctgggtcggagctgcggggggcctgggaggagagaggggagaagagagaaggaaggagagcgcctgccgggatggctgagctgcctcggcgagcagccttggggttgcacgctcttgtgggagatgctgctgttgcttccaggtcggcaagagcggttctaacaccatcgcctctcaccctctttcctgtaaatccctagagaaacgtccctggcctctccgccgcgacattcccagcctgcatccccctacagcctaggcggcgcgctcccgcacgctggagcgccggtcgccagcaggacgccctctcccgcgccgactcgcccctctctgccctgctgctgctgctcctctgacacctccgcccccaccatctccagctcggagagacgccacccagccgcggcccgcactcgcggcccggggtcacgcgcggaagaggggcgctagtccggaccccgccttcggtagggggcgtcctggagcggagagtgaggcgaatggtatatgagtgtgcgggtagcccaccctgaagcccgagcttctcatttgagccatccccgcctagccccactcgggccagcgcctggcgagcgagcccatctgtggcttccgcggccgcctcctccttgcatccttgcacctcctcgtcgacccctccctcccgggacctgcatcctgctccaccaatcagagcccgactgcctcttcccacgtgaccccgggcgggctgaggacctgctgcttcccaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaa

SEQ ID NO: 194465 - DNA, 2842 bp, Homo sapiens
  Payload ID: 18431
  Gene Name: transmembrane protein with EGF-like and two follistatin-like domains 2
  Uniprot ID: Q9UIK5
  ENST ID: ENST00000392314
  CDS Start-End: 393-1433
agagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttaggtaatagcattggactgagatttgtaaactttccaaccttccaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaattggcattcttaaatttgcggtatctcataactgtaaatataatcagactagtacaatctgtacagctaccaatatttcatgtttcttctcatcttgagacagcacattagttcgtacaggactcagtggctaggttttgaatgattccaagatcaagggaaatgatggttattggaaaagagaaaaaataatttactttatatcgagtgaggataaaatatttccgatctttgaatcatctctatttcatcaactttcttccctggtcttccattttcatccctagagcagaaaaatctctggcatataaactaaataaaagaagaaggggagggaaagtgttttataactcataaaggagagggaaagaaaatattggtttttattggggaagtagcttagaatcccccagttaagtgcatatatctgaacttactgaacaagttacatactaggtatacacagagtggcaaaatatattccatttaggtgggtggaattaccaggggaaaaatgtaataacaccactagatgtgaaacaccaaaatcgtgaattctcaaaagcaccatacaatatgtatagtatatagttctttgaaaagaagttagaatcacaaccaataccccatgaatagctttgtggctaatgcagcaccataatttgtaatggaactaagatgatgatgacgatatttcatgaaaacagagagatgttttgagcatatttatgtggtgaggtaagaaagaaaattaatcctatagcatctgaaagacctcactgggaagttggtatggatttttgtttgatttgtgcatacaaataggtatcacaacttgatctggaaaaaataagctgtgaaaattctcaaggaataagatgaaaataaatcaattattatcatttagctctgcaaagctttccatggctaacacagtaaatttaaataaagctctctttgtctccttcaaataa

SEQ ID NO: 194466 - DNA, 3364 bp, Homo sapiens
  Payload ID: 18431
  Gene Name: transmembrane protein with EGF-like and two follistatin-like domains 2
  Uniprot ID: Q9UIK5
  ENST ID: ENST00000409056
  CDS Start-End: 1-528
atggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggaggtaggagttgcctttttacatatttgaagatttactggtggatattattatgtatatttacttatgtatgttccatttcagatatttaagacaaatttcatattttgcattttaggaaaggtgaaaccataaaaaattgtcaccatattaagtacatgtatataccgtgcaaattatttggcatacttatgaatcatactctatctccagttaaccttccttgttcatttgtttgtttgtttgtttgtaagttatctttgatatggataggcataatgtaaaaacttctgaagagaagcatgtaagcatatttggcagggaagaaagaattcatgaggaaatcatttaaatattggatttttaaatatatgacactgctctcaattactaggtgctaataagacatacataacctaccatatagccaaggttttaattatcagatttataatttgaaactgaaggaactttagttcataaaagtgaaaaagataaaatgaagtccaatgaaagtaaaatattatctttgcttccttgattaaatctatagttatttttactaaagtatgatatatgttcccattatttagttttgtttagggaagtatataagatgagagagagagagagagaaactttaaaagtttgatctaatgtacttactaccaaataaagattttacctatagattgaaactaaattgtaaatgtcccaaatacttttcccgatgaaattcaaacaaaattagacttttatacacacaaagcaaaacaaaacacaacctatatataatttcaagattaagaaaaacaaaacaaataaaagcattctctcaagaccttgcttcagttgtgtaaaataattaaatgtgctattccaagttgattttagtttttaaatacagaatttgataaaagataagtaaaagaaggccttgggttcagggtggcagatatttagtgcaccctttatctagttcaggaaacacttgaaagatttatcaagtttccttatgtaatgaaagacttaactagttcaaataagcaatacccacagaacataattagagcagcatattggagcacaatttttttttcataaagactaaaactgaacagcagcagattgaaacacaatttttttcctaaagactaaaactgaacagcagtcaagactcaagcatagaatatgtttcaatgtcccatgatgttggacagtcctttgatgtctggacagtctttctctacttctaataaaagttttcctagctgattaatatagtattcccaagaaagcgtccctagaggttttgaaaataagaccttagaatagcatattaaatcttaaagaaaaaaaaaagacaggaaaaaaggcagttcctttagtagatgttttaccatgggaatattattaataagaaatcaattaattttttaaaatgttgcttttgtaaggaaacagtttctatgcaaaattctgtatattttctagctgtttagttttatatgtagactacctaattttgcaaatattgtgctgagactgaactgttccactgtttacccaccagtcttgttaattttctagcatctttaaagacaaaataaaacataccaagaatgtcttcatttctctttctgttaaagcatcatcatttacttttttctgcttgactatcctaccatactgtacttcatatctttatttttctaacaataagatgtgaactttgtttcacatactagtttctagttttcattcattgttattagcacatgcaaatggaaatgaagtcaaactcactcttccctgttgcgttttatattaaaatctttggttcattatgttgtcttgtgatctgaataagacattttttcaggaaataattttaatctcatgaatatgacatgtataacttataccatataagtgaaacatcacttggaaaacactttattttctttctctttttctgttttttaatcactcttcctttcagttagaggtgcttcatagtaacttggagaaaacaaaaacaacttccgatgtttgctttagaaaaaaaaagcatataacacatttaattctgagcttattcttttaaataactgcagttctgaaaattgtggtgatgagtatttgctcctaattgcatacaatttttaaaattagagactgatcaggtttttctcaacagaactgcttgtttttctagtctacatgttactttggtctgtaagactattagttttaattttctttaaattctttattgagggatgccaaaaatgcttagtaactaaaacctaaaaacctagtttagaataacttgcacaaattcagttcacatatccattgggttgtaatcgtaagatatatttgacttgctatctctcttatacagatgatagactttcctctgtatttttgtagaattcgtattaccaaggttttgagagggcagaatcagcttccttcatttttgaataaagcaaaagtgattgaataacttgtgattgtttggctaatccaacaattgtaactagtgattgttctaactaatctctatataacatattctcagtaatgtgtatttaattaataattgggtttacttggcaagcactttggatggttaatagttattttctaatttcttattttaacaaaagttaatataattccaaaatggagtacactgaacaaaagagtgaagggaacaaatttacttgtaaaacatttatcatgtgtgactatcataaatgatatcattaaacttacaaatctaaaatcatgtaaaaatatatcaaatattactttttaaaaattttcctatattttagcgtgaatgaatattacattagtaatgaaaattagacctgattattctaaaaataatttaagcttaacccatttgcacaaggg

SEQ ID NO: 194467 - DNA, 3962 bp, Homo sapiens
  Payload ID: 18432
  Gene Name: transmembrane protein with metallophosphoesterase domain
  Uniprot ID: Q6ZT21
  ENST ID: ENST00000342462
  CDS Start-End: 192-1553
agctcggtcgcttgtgcgttccgctccggccgccctttgcgcttggatccacttccccatctgtaacgaggtgttgagacgaggcggagttgacctggaaacctctccttggccactgtcctttctaaggaactcatttccagagtccaccagcacagaactggtgggggagcctactaggagcagagaaaatggccatcttcaggcagctgtccctaggcgcgaaggccaccctggctgctgtcactgtcttcgtgtccatgatcgcctcccgctcgtatctggcagagagccttgagctcagggcctggcgttggctgcttcgcttgcagcttgccctgtttgtcaactcgctcttgctcattggctccctctacatttggcgcagcacagtgagcaacctctgccactccccagctgcagagtcaacctgttttcagctttggaaggtggtggttctggcatttctggccctggcccattccagtttctttaccatgttctttttagtggccgaagagccctatctcttttccttggcggcctactcctgcctgggtgcttacatcatcatgctcttcttcctcttcatcctcagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagcgtgcacagtaaacactcaatgttaatttttcaacgttccagtggagcttgctaaggaactctgttgggcacaggtgcccagaggattcatggagcagccagtcctggggaatgtgagtgggtagcgagctgcctgctgctggggcaggtgatgtgtcaaagcagcaactgctaggggtttgccttccttccctcatgtgcattctggcaggcaaagggggtttcttcctttcctccttgtcctcctggtgtatagtggggttctgggggatctggagaccaccctttttgttcccaggcagccacggtattgacagtgggccataccatgcagtttaaaatgtatctttgagttgaaattttggtggtttccttattcttttttctctcttcactgtccttccaaactcacttttcttgtgtcccgaccgcattttgtgaatcatccttactccctttaagttctcgctttggatttcaccaggtgggctagatggtgccatttcacttccactgtttgatgcggctggtaatgtttgactcacctgttacgtgttatttcactggtttcttgattttacatctttctcatcagtgacctgggcttgatgaaattagctttcattaagtcctattttttttttaattttgcatccttacctcttttctttctcttgaatgccatcattgtgtggtcttatgtacccttcatccactctgaagtccttgcttgactgattgctttctattagcagaaagaaaacaggtccatcctatgtatctgagaaacaacatcaacaccctctcgtatgtggtttgtattccctgacgcggcggacatttttgcagcagaaatttctccatcactgtccagattctggccctggtgggcaggtctccatgacacctttagtccctttgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttcc

SEQ ID NO: 194468 - DNA, 3451 bp, Homo sapiens
  Payload ID: 18432
  Gene Name: transmembrane protein with metallophosphoesterase domain
  Uniprot ID: Q6ZT21
  ENST ID: ENST00000416695
  CDS Start-End: 88-1038
agctcggtcgcttgtgcgttccgctccggccgccctttgcgcttggatccacttccccatctgtaacgaggtgttgagacgagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagcgtgcacagtaaacactcaatgttaatttttcaacgttccagtggagcttgctaaggaactctgttgggcacaggtgcccagaggattcatggagcagccagtcctggggaatgtgagtgggtagcgagctgcctgctgctggggcaggtgatgtgtcaaagcagcaactgctaggggtttgccttccttccctcatgtgcattctggcaggcaaagggggtttcttcctttcctccttgtcctcctggtgtatagtggggttctgggggatctggagaccaccctttttgttcccaggcagccacggtattgacagtgggccataccatgcagtttaaaatgtatctttgagttgaaattttggtggtttccttattcttttttctctcttcactgtccttccaaactcacttttcttgtgtcccgaccgcattttgtgaatcatccttactccctttaagttctcgctttggatttcaccaggtgggctagatggtgccatttcacttccactgtttgatgcggctggtaatgtttgactcacctgttacgtgttatttcactggtttcttgattttacatctttctcatcagtgacctgggcttgatgaaattagctttcattaagtcctattttttttttaattttgcatccttacctcttttctttctcttgaatgccatcattgtgtggtcttatgtacccttcatccactctgaagtccttgcttgactgattgctttctattagcagaaagaaaacaggtccatcctatgtatctgagaaacaacatcaacaccctctcgtatgtggtttgtattccctgacgcggcggacatttttgcagcagaaatttctccatcactgtccagattctggccctggtgggcaggtctccatgacacctttagtccctttgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttccaaat

SEQ ID NO: 194469 - DNA, 1725 bp, Homo sapiens
  Payload ID: 18433
  Gene Name: transmembrane protein, adipocyte asscociated 1
  Uniprot ID: Q86W33
  ENST ID: ENST00000296210
  CDS Start-End: 316-1197
ggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaa

SEQ ID NO: 194470 - DNA, 1933 bp, Homo sapiens
  Payload ID: 18433
  Gene Name: transmembrane protein, adipocyte asscociated 1
  Uniprot ID: Q86W33
  ENST ID: ENST00000355552
  CDS Start-End: 378-1499
gagtgataacagggactctgggactctgggacttgtgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataa

SEQ ID NO: 194471 - DNA, 1831 bp, Homo sapiens
  Payload ID: 18433
  Gene Name: transmembrane protein, adipocyte asscociated 1
  Uniprot ID: Q86W33
  ENST ID: ENST00000393400
  CDS Start-End: 343-1062
tgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctgctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttt

SEQ ID NO: 194472 - DNA, 1865 bp, Homo sapiens
  Payload ID: 18433
  Gene Name: transmembrane protein, adipocyte asscociated 1
  Uniprot ID: Q86W33
  ENST ID: ENST00000450633
  CDS Start-End: 292-1413
gccttgcacatggagatgcttagctgagggggtggctttgttagactatttgcaggtcgtgagatagagcctgagatgggggactgggcccctgcctgggggattgggtcgtgacctgtgtggagccccacactgagctgcagtgggtggggagggtggtttacaggggtgctctgtgcagcccctctgattttcccctgggagtcccaggtccaggggaaggaggacagtggcccaggccacacagctcactgggcggctctcactcccccagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaa

SEQ ID NO: 194473 - DNA, 841 bp, Homo sapiens
  Payload ID: 18433
  Gene Name: transmembrane protein, adipocyte asscociated 1
  ENST ID: ENST00000490290
  CDS Start-End: 231-841
ggccgcggcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggt

SEQ ID NO: 194474 - DNA, 1903 bp, Homo sapiens
  Payload ID: 18433
  Gene Name: transmembrane protein, adipocyte asscociated 1
  Uniprot ID: Q86W33
  ENST ID: ENST00000489960
  CDS Start-End: 407-1528
gcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaa

SEQ ID NO: 194475 - DNA, 1720 bp, Homo sapiens
  Payload ID: 18433
  Gene Name: transmembrane protein, adipocyte asscociated 1
  ENST ID: ENST00000483868
  CDS Start-End: 312-989
ggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtg

SEQ ID NO: 194476 - DNA, 713 bp, Homo sapiens
  Payload ID: 18433
  Gene Name: transmembrane protein, adipocyte asscociated 1
  ENST ID: ENST00000462228
  CDS Start-End: 589-713
ggagcggaggtagaagctgaggctccaggggacccgacgacacttgctggctgcgtgacctcggtcacaccagggccattttgctgacaagacaacagaggccgggcgcggtggctcacgcctgtaatcccagcactttgggaagccgaggtgggcggatcacaagctcaggagttcgagaccagcctgactaacatgcgagaagtgagtcctgaggtccggcccacactgaaggagaggagatcctagcagggctggggattatcaggagccctcccaaaggccactgaagagagcagtcaagatggtggatggggtcagctggctgcccagaggtcatctgataaggactaggagctgttagtggccctggcgatagcagatctgggctggccggtgtgtctggagtcagacactacattgaagtgtgttgacaggtcagtaggcatccagcgctggggcagctgcttcaggacatcgccgaggacaagtctcctccccattctggttccaccatctgtagcctgtggctttcatcctcaagggctccatgcgaccgctgcacatccagggctggctgctggcgggatggacaccctggaggaggtgacttgggccaatgggagcacagcgctacccccacccctggcaccaaacatcagtgtgcctcatcgctgcctgctgctgctctacgaagacattggcacctccag

SEQ ID NO: 194477 - DNA, 1007 bp, Homo sapiens
  Payload ID: 18433
  Gene Name: transmembrane protein, adipocyte asscociated 1
  ENST ID: ENST00000469111
  CDS Start-End: 399-1007
gaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcaggtggagaagccgaggcctggagaggggcacctggcaagttgttgactgggggcctgggctctggagacagacagcctggattgctggcctgggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctg

SEQ ID NO: 194478 - DNA, 767 bp, Homo sapiens
  Payload ID: 18433
  Gene Name: transmembrane protein, adipocyte asscociated 1
  ENST ID: ENST00000490643
  CDS Start-End: 269-767
cggcccggcgctgtgcgcgtgcgctcgcctgcgctgtggtgggagctggagcggaggtcagtaggcatccagcgctggggcagctgcttcaggacatcgccgaggacaagtctcctccccattctggttccaccatctgtagcctgtggctttcatcctcaagggctccatgcgaccgctgcacatccaggacaggagcaaggagaagaatgggacccaatctcattccagcccagcggtgctgtcgcaagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccagg

SEQ ID NO: 194479 - DNA, 2273 bp, Homo sapiens
  Payload ID: 18434
  Gene Name: transport and golgi organization 2 homolog
  Uniprot ID: Q6ICL3
  ENST ID: ENST00000327374
  CDS Start-End: 179-1009
cggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 194480 - DNA, 2011 bp, Homo sapiens
  Payload ID: 18434
  Gene Name: transport and golgi organization 2 homolog
  Uniprot ID: Q6ICL3
  ENST ID: ENST00000398042
  CDS Start-End: 103-747
actgggctggctgcggtggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 194481 - DNA, 2241 bp, Homo sapiens
  Payload ID: 18434
  Gene Name: transport and golgi organization 2 homolog
  ENST ID: ENST00000399807
  CDS Start-End: 203-655
ggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaact

SEQ ID NO: 194482 - DNA, 1920 bp, Homo sapiens
  Payload ID: 18434
  Gene Name: transport and golgi organization 2 homolog
  Uniprot ID: Q6ICL3
  ENST ID: ENST00000401833
  CDS Start-End: 265-1218
gtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagac

SEQ ID NO: 194483 - DNA, 1559 bp, Homo sapiens
  Payload ID: 18434
  Gene Name: transport and golgi organization 2 homolog
  Uniprot ID: Q6ICL3
  ENST ID: ENST00000401886
  CDS Start-End: 219-863
cggccccgcacctgcccgaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttt

SEQ ID NO: 194484 - DNA, 2086 bp, Homo sapiens
  Payload ID: 18434
  Gene Name: transport and golgi organization 2 homolog
  ENST ID: ENST00000447208
  CDS Start-End: 218-823
ggtactgggctggctgcggtggcgcgcgggcgcggcacccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgaggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgc

SEQ ID NO: 194485 - DNA, 2180 bp, Homo sapiens
  Payload ID: 18434
  Gene Name: transport and golgi organization 2 homolog
  Uniprot ID: Q6ICL3
  ENST ID: ENST00000434570
  CDS Start-End: 223-819
ggtactgggctggctgcggtggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgc

SEQ ID NO: 194486 - DNA, 847 bp, Homo sapiens
  Payload ID: 18434
  Gene Name: transport and golgi organization 2 homolog
  ENST ID: ENST00000444651
  CDS Start-End: 41-370
gacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtatacca

SEQ ID NO: 194487 - DNA, 1859 bp, Homo sapiens
  Payload ID: 18434
  Gene Name: transport and golgi organization 2 homolog
  ENST ID: ENST00000420290
  CDS Start-End: 106-429
ggtactgggctggctgcggtggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgc

SEQ ID NO: 194488 - DNA, 2084 bp, Homo sapiens
  Payload ID: 18434
  Gene Name: transport and golgi organization 2 homolog
  Uniprot ID: Q6ICL3
  ENST ID: ENST00000432883
  CDS Start-End: 285-821
ggtactgggctggctgcggtggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgc

SEQ ID NO: 194489 - DNA, 1689 bp, Homo sapiens
  Payload ID: 18434
  Gene Name: transport and golgi organization 2 homolog
  ENST ID: ENST00000450019
  CDS Start-End: 180-545
ccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagggggccccatatcagtgttcctgggagaagagcacatgcctgcagctgtggacacagcatctgtcccctgcctacaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttg

SEQ ID NO: 194490 - DNA, 733 bp, Homo sapiens
  Payload ID: 18434
  Gene Name: transport and golgi organization 2 homolog
  ENST ID: ENST00000430807
  CDS Start-End: 160-489
cggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcg

SEQ ID NO: 194491 - DNA, 2439 bp, Homo sapiens
  Payload ID: 18434
  Gene Name: transport and golgi organization 2 homolog
  Uniprot ID: Q6ICL3
  ENST ID: ENST00000456048
  CDS Start-End: 223-1176
ggtactgggctggctgcggtggcgcgcgggcgcggcacccggaagtcggcggcggtggcggaggcgacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgc

SEQ ID NO: 194492 - DNA, 862 bp, Homo sapiens
  Payload ID: 18434
  Gene Name: transport and golgi organization 2 homolog
  ENST ID: ENST00000434168
  CDS Start-End: 184-862
ctggccgactccgctagtggcccggccggcctgggctcgggggctccgggctctgggctctgggtgcgcggaccgggccaggctgcttgaaggtgggtgggctggccgcacttcctcaccctgcctcagtttcccctttctgagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctg

SEQ ID NO: 194493 - DNA, 585 bp, Homo sapiens
  Payload ID: 18434
  Gene Name: transport and golgi organization 2 homolog
  ENST ID: ENST00000432198
  CDS Start-End: 321-585
gaacctctgcggcggcggtggcagggtacgcgggaccgctccctcccagccgacttacgagaacatcccccgaccatccagccccgagcagggactggcagagccggcgccccttccccggactctggccgcgtagcctccgccaccactcccagttcacagctccatgcggacagctgtgaggcccccggagaaagccacagagagaaaatgctttcagctgggtgtcaagaacttttcaagagtggcagctgttgaaatcaaaagagtggccacagaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgag

SEQ ID NO: 194494 - DNA, 570 bp, Homo sapiens
  Payload ID: 18434
  Gene Name: transport and golgi organization 2 homolog
  ENST ID: ENST00000450664
  CDS Start-End: 73-568
ggcacccggaagtcggcggcggtggcggaggcgacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaag

SEQ ID NO: 194495 - DNA, 4816 bp, Homo sapiens
  Payload ID: 18435
  Gene Name: transport and golgi organization 6 homolog
  Uniprot ID: Q9C0B7
  ENST ID: ENST00000261778
  CDS Start-End: 13-3297
tacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccagtcctgcacagatgtgaagacacagatgaggtgtcgggccccagcttggcttcggcgtctatgtggacagctgctctctgaaaggttaatgagacctaatggtgttcaggcagtagtccggggcattttggaaggagcaggtgcgggagcagctggtggaagtgatgctgaggtgacggctgctgactggaagaagtgtgacctgatcgcaaagattttggcctcttgtccccagcagtctctttcaccagagaattactacagggacatctgcccccaggttctggatttatttcactttcaagataaattgacagcacgacaatttcagagagttgccaccactacctttataactttgtcaagagaacgcccacatttggcagcaaagtatttgctccagccagtgttagctcctcttcatcgatgtttgaatacagcagagctttcagagagtgacatggtaccaggaactattttggtgacagaagaagaacttagtagatgcattgaggatgtgtttaaggtgtacgtggttgggaatgaacctttaacagttttgatggattccctgcttccagtcctgggagtgctttttcttctctactgttttactaagcagagtgtgtctcacataaggtcactttgccaagaaatcttattatggattctggggaagctggaaaggaagaaggcaattgccagcctgaaaggatttgcagggttggacaaagctgtgccctctctccattctctgtgtcagtttagagttgccactcaaggtggcattatgattaccatcaaagaggccattagtgatgaagatgaagatgaagccctgtaccagaaggtatcctctgagcagggccgggtggagcatctcggggacttgctgtcccactgccaggaatgcggtttggcaggagacttcttcatcttctgtttgaaagagttgactcatgtggcctcggaaaatgaaacagagttaaaaactgagcccttctccagcaagagcctcttggaattagagcaacatcagactcttcttgtggaaggccaagagcggaagctgcttgtcctgcagctgatggctgttctgtgcgagagaatgtctgagcagatattcacaaacgtcactcaggtggtggactttgtagcagcaacattgcagagagcctgtgcaagcctggcccatcaggcagagagcaccgtggaatcacagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatggaaagaacagggctaaatctggtcctctggtgtcgagatggaaaactgtggagttgaagaggctctgatgcccagaaaggacaatcaagctggttgactcttccagagaagaagggtaagccctgtatttatcctcccaggccattcttcttcactcctgctgctgtttgcagagagttgccctgattatcaggagaaaagaaccacgagcatccagagagtttacatcctgccttctgtcctctgctccttcagaaagatgaatgcctagacaatgggttcacactgaatgcaggctggaaagaatgcatgctggtggcctaatgccagggctgttgaaacaatttcagatatagcactgtggtctccactttatttctttatatgttttggccgctgcattttgattgcagctaaaagagataacagaaaggagatactggctggctgcttcatattagccctctctgttgtcaacaccttgatgaggccaacccagagatgcttgatcagtcctcagctttgcagggctaggtacagaattttatcacaggattttatcacgctctctggggtgactagatccacaggaaccaaaacgcagtttccaaaagctcgagtgactgaaggatctatacacaaacatggctatttgctagttaacaacaggatatttctctctggccagatcacagacatggttctgagtcagatcttccttggtggcatccctttaaagaggccatcttatgaacaggatcacaagtgagcttagtgagcagagagttagaacaaatctagctaggtgtgtttaaggaatatttccattcagctagtgtagctggattaatttctattctccaaatcaaggatgtctagaaaatgggcattgtggctttcaaatctaagaagaatctcctttgggccagctggatgtacaataaaaatgcttgtttcttggccttccttt

SEQ ID NO: 194496 - DNA, 552 bp, Homo sapiens
  Payload ID: 18435
  Gene Name: transport and golgi organization 6 homolog
  ENST ID: ENST00000565852
  CDS Start-End: 1-112
gattttggcctcttgtccccagcagtctctttcaccagagaattactacagggacatctgcccccagtttttttgtaggttctggatttatttcactttcaagataaattgacagcacgacaatttcagagagttgccaccactacctttataactttgtcaagagaacgcccacatttggcagcaaagtatttgctccagccagtgttagctcctcttcatcgatgtttgaatacagcagagctttcagagagtgacatggtaccaggaactattttggtgacagaagaagaacttagtagatgcattgaggatgtgtttaaggtgtacgtggttgggaatgaacctttaacagttttgatggattccctgcttccagtcctgggagtgctttttcttctctactgttttactaagcagagtgtgtctcacataaggtcactttgccaagaaatcttattatggattctggggaagctggaaaggaagaaggcaattgccagcctgaaaggatttgcagggttggacaaagctgtgccctctctccattct

SEQ ID NO: 194497 - DNA, 573 bp, Homo sapiens
  Payload ID: 18435
  Gene Name: transport and golgi organization 6 homolog
  ENST ID: ENST00000561856
  CDS Start-End: 1-83
agatattcacaaacgtcactcaggtcagtagttgccacattctggaccgcagcctttttttctttccaaaaaataaagtttaaaaatgttgctgagagtgtgatttgatgacacctggatcatgaggtgtttcctggaatgctggttaaatatggaaactacacagcccacaccaggccactgaatccaaaacgttccagtgtcctgagactccacacgtttaacaagctcccgaggtggtggactttgtagcagcaacattgcagagagcctgtgcaagcctggcccatcaggcagagagcaccgtggaatcacagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatag

SEQ ID NO: 194498 - DNA, 2959 bp, Homo sapiens
  Payload ID: 18436
  Gene Name: transporter 1, ATP-binding cassette, sub-family B (MDR/TAP)
  Uniprot ID: Q03518
  ENST ID: ENST00000354258
  CDS Start-End: 163-2589
gagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgta

SEQ ID NO: 194499 - DNA, 2959 bp, Homo sapiens; identical to SEQ ID NO: 194498
  Payload ID: 18436
  Gene Name: transporter 1, ATP-binding cassette, sub-family B (MDR/TAP)
  Uniprot ID: Q03518
  ENST ID: ENST00000383235
  CDS Start-End: 163-2589

SEQ ID NO: 194500 - DNA, 2959 bp, Homo sapiens; identical to SEQ ID NO: 194498
  Payload ID: 18436
  Gene Name: transporter 1, ATP-binding cassette, sub-family B (MDR/TAP)
  Uniprot ID: Q03518
  ENST ID: ENST00000418205
  CDS Start-End: 163-2589

SEQ ID NO: 194501 - DNA, 2959 bp, Homo sapiens; identical to SEQ ID NO: 194498
  Payload ID: 18436
  Gene Name: transporter 1, ATP-binding cassette, sub-family B (MDR/TAP)
  Uniprot ID: Q03518
  ENST ID: ENST00000440894
  CDS Start-End: 163-2589

SEQ ID NO: 194502 - DNA, 2959 bp, Homo sapiens; identical to SEQ ID NO: 194498
  Payload ID: 18436
  Gene Name: transporter 1, ATP-binding cassette, sub-family B (MDR/TAP)
  Uniprot ID: Q03518
  ENST ID: ENST00000414467
  CDS Start-End: 163-2589

SEQ ID NO: 194503 - DNA, 2959 bp, Homo sapiens
  Payload ID: 18436
  Gene Name: transporter 1, ATP-binding cassette, sub-family B (MDR/TAP)
  ENST ID: ENST00000428324
  CDS Start-End: 163-2589
gagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacgggtggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgta

SEQ ID NO: 194504 - DNA, 2959 bp, Homo sapiens; identical to SEQ ID NO: 194498
  Payload ID: 18436
  Gene Name: transporter 1, ATP-binding cassette, sub-family B (MDR/TAP)
  Uniprot ID: Q03518
  ENST ID: ENST00000424897
  CDS Start-End: 163-2589

SEQ ID NO: 194505 - DNA, 2959 bp, Homo sapiens
  Payload ID: 18436
  Gene Name: transporter 1, ATP-binding cassette, sub-family B (MDR/TAP)
  Uniprot ID: Q03518
  ENST ID: ENST00000439781
  CDS Start-End: 163-2589
gagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccagacccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgta

SEQ ID NO: 194506 - DNA, 5684 bp, Homo sapiens
  Payload ID: 18437
  Gene Name: transporter 2, ATP-binding cassette, sub-family B (MDR/TAP)
  Uniprot ID: Q03519
  ENST ID: ENST00000374897
  CDS Start-End: 133-2193
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttgtaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 194507 - DNA, 2497 bp, Homo sapiens
  Payload ID: 18437
  Gene Name: transporter 2, ATP-binding cassette, sub-family B (MDR/TAP)
  Uniprot ID: Q03519
  ENST ID: ENST00000374899
  CDS Start-End: 80-2041
gaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 194508 - DNA, 5684 bp, Homo sapiens
  Payload ID: 18437
  Gene Name: transporter 2, ATP-binding cassette, sub-family B (MDR/TAP)
  Uniprot ID: Q03519
  ENST ID: ENST00000383118
  CDS Start-End: 133-2193
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 194509 - DNA, 2497 bp, Homo sapiens
  Payload ID: 18437
  Gene Name: transporter 2, ATP-binding cassette, sub-family B (MDR/TAP)
  Uniprot ID: Q03519
  ENST ID: ENST00000383119
  CDS Start-End: 80-2041
gaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcagtggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 194510 - DNA, 5684 bp, Homo sapiens
  Payload ID: 18437
  Gene Name: transporter 2, ATP-binding cassette, sub-family B (MDR/TAP)
  Uniprot ID: Q03519
  ENST ID: ENST00000383239
  CDS Start-End: 133-2193
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 194511 - DNA, 2497 bp, Homo sapiens; identical to SEQ ID NO: 194509
  Payload ID: 18437
  Gene Name: transporter 2, ATP-binding cassette, sub-family B (MDR/TAP)
  Uniprot ID: Q03519
  ENST ID: ENST00000383240
  CDS Start-End: 80-2041

SEQ ID NO: 194512 - DNA, 2497 bp, Homo sapiens
  Payload ID: 18437
  Gene Name: transporter 2, ATP-binding cassette, sub-family B (MDR/TAP)
  Uniprot ID: Q03519
  ENST ID: ENST00000426977
  CDS Start-End: 80-2041
gaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 194513 - DNA, 5684 bp, Homo sapiens
  Payload ID: 18437
  Gene Name: transporter 2, ATP-binding cassette, sub-family B (MDR/TAP)
  Uniprot ID: Q03519
  ENST ID: ENST00000419142
  CDS Start-End: 133-2193
gagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcataaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattacttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 194514 - DNA, 2497 bp, Homo sapiens; identical to SEQ ID NO: 194512
  Payload ID: 18437
  Gene Name: transporter 2, ATP-binding cassette, sub-family B (MDR/TAP)
  Uniprot ID: Q03519
  ENST ID: ENST00000451907
  CDS Start-End: 80-2041

SEQ ID NO: 194515 - DNA, 5511 bp, Homo sapiens
  Payload ID: 18437
  Gene Name: transporter 2, ATP-binding cassette, sub-family B (MDR/TAP)
  ENST ID: ENST00000455842
  CDS Start-End: 133-2244
gagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaagcacgatggagatttggacactgtgtgcttttggtggggtggagaggtggggtggggtggggtgtggtggggtggaggctgtctgtgtccaggaaacttaattccctggtgactagagctttgcctggtgatgaggagtattttgtggcataatacatatattttaaaatattttccttcttacgtgaactgtatacattcatatagaaaatttagacaatataaaaaagtacaaagaagaaaagtaaaagtacccattgtttcacttcctggagataaccatagttgctattttgctgcctgttccatcagtcgtttatctgttgtttgagatagaaattaaccaaaaatgacataaatattcatgagattgccttcctatatccctccttgttcctaccagtgtctgctattttgaagaagctagggtctggagggacagagaacagttccctgattaacagtattaataatgacattggtaacagctaccatttatagagttttaatgtgagtaggagctatgctaagtgtttttcatgtattatcgtttttaatcattatctccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaatagtaattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgattccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagt

SEQ ID NO: 194516 - DNA, 5684 bp, Homo sapiens
  Payload ID: 18437
  Gene Name: transporter 2, ATP-binding cassette, sub-family B (MDR/TAP)
  Uniprot ID: Q03519
  ENST ID: ENST00000443713
  CDS Start-End: 133-2193
gagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaatgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctctaggagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 194517 - DNA, 2497 bp, Homo sapiens; identical to SEQ ID NO: 194512
  Payload ID: 18437
  Gene Name: transporter 2, ATP-binding cassette, sub-family B (MDR/TAP)
  Uniprot ID: Q03519
  ENST ID: ENST00000439425
  CDS Start-End: 80-2041

SEQ ID NO: 194518 - DNA, 2497 bp, Homo sapiens
  Payload ID: 18437
  Gene Name: transporter 2, ATP-binding cassette, sub-family B (MDR/TAP)
  Uniprot ID: Q03519
  ENST ID: ENST00000414145
  CDS Start-End: 80-2041
gaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaatgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 194519 - DNA, 5511 bp, Homo sapiens; identical to SEQ ID NO: 194515
  Payload ID: 18437
  Gene Name: transporter 2, ATP-binding cassette, sub-family B (MDR/TAP)
  ENST ID: ENST00000452371
  CDS Start-End: 133-2244

SEQ ID NO: 194520 - DNA, 2497 bp, Homo sapiens
  Payload ID: 18437
  Gene Name: transporter 2, ATP-binding cassette, sub-family B (MDR/TAP)
  ENST ID: ENST00000445986
  CDS Start-End: 80-2041
gaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcataaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattacttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacatcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaac

SEQ ID NO: 194521 - DNA, 5517 bp, Homo sapiens
  Payload ID: 18437
  Gene Name: transporter 2, ATP-binding cassette, sub-family B (MDR/TAP)
  ENST ID: ENST00000457634
  CDS Start-End: 133-2244
gagccctgacgcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaaggggagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcaggcagttcagcgcgcccaccagatcctggtgctccaggagggcaagctgcagaagcttgcccagctccaggagggacaggacctctattcccgcctggttcagcagcggctgatggactgaggccccagggatactgggccctcttctcaggggcgtctccaggacccagagctgttcctgctttgagtttccctagagctgtgcggccagatagctgttcctgagttgcaagcacgatggagatttggacactgtgtgcttttggtggggtggagaggtggggtggggtggggtgtggtggggtggaggctgtctgtgtccaggaaacttaattccctggtgactagagctttgcctggtgatgaggagtattttgtggcataatacatatattttaaaatattttccttcttacgtgaactgtatacattcatatagaaaatttagacaatataaaaaagtacaaagaagaaaagtaaaagtacccattgtttcacttcctggagataaccatagttgctattttgctgcctgttccatcagtcgtttatctgttgtttgagatagaaattaaccaaaaatgacataaatattcatgagattgccttcctatatccctccttgttcctaccagtgtctgctattttgaagaagctagggtctggagggacagagaacagttccctgattaacagtattaataatgacattggtaacagctaccatttatagagttttaatgtgagtaggagctatgctaagtgtttttcatgtattatcgtttttaatcattatctccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaatagtaattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgattccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattcta

SEQ ID NO: 194522 - DNA, 5676 bp, Homo sapiens
  Payload ID: 18437
  Gene Name: transporter 2, ATP-binding cassette, sub-family B (MDR/TAP)
  ENST ID: ENST00000619283
  CDS Start-End: 123-2231
gcccgccctggccgagcgtagctggcggaccagagccggtagcgaggttgggagagacggagcggacctcagcgctgaagcagaagcccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcataaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattacttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctcgagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctatttta

SEQ ID NO: 194523 - DNA, 5676 bp, Homo sapiens
  Payload ID: 18437
  Gene Name: transporter 2, ATP-binding cassette, sub-family B (MDR/TAP)
  ENST ID: ENST00000613095
  CDS Start-End: 123-2231
gcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctcgagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggagtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctatttta

SEQ ID NO: 194524 - DNA, 5676 bp, Homo sapiens
  Payload ID: 18437
  Gene Name: transporter 2, ATP-binding cassette, sub-family B (MDR/TAP)
  ENST ID: ENST00000620674
  CDS Start-End: 123-2231
gcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaatgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctcgagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctatttta

SEQ ID NO: 194525 - DNA, 5676 bp, Homo sapiens
  Payload ID: 18437
  Gene Name: transporter 2, ATP-binding cassette, sub-family B (MDR/TAP)
  ENST ID: ENST00000612574
  CDS Start-End: 123-2231
gcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctcgagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactcctactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctatttta

SEQ ID NO: 194526 - DNA, 5676 bp, Homo sapiens
  Payload ID: 18437
  Gene Name: transporter 2, ATP-binding cassette, sub-family B (MDR/TAP)
  ENST ID: ENST00000620123
  CDS Start-End: 123-2231
gcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccctgcaggactggaattcccgtggggatcgcacagtgctggtgattgctcacaggctgcagacagttcagcgcgcccaccagatcctggtgctccaggagggcaagctgcagaagcttgcccagctcgagggacaggacctctattcccgcctggtgcagcagcggctgatggactgaggccccagggatactgggccctcttctcaggggcgtctccaggacccagagctgttcctgctttgagtttccctagagctgtgcggccagatagctgttcctgagttgcaggcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacatgaactgtatacattcatatagaaaatttagacaatataaaaaagtacaaagaagaaaagtaaaagtacccattgtttcacttcctggagataaccatagttgctattttgctgcctgtcccatcagtcgtttatctgttgtttgagatagaaattaaccaaaaatgacataaatattcatgagattgccttcctatatccttccttgttcctaccagtgtctgctattttgaagaagctagggtctggagggacagagaacagttccctgattaacagtattaatagcgacattggtaacagctaccatttatagagttttaatgggagtaggagctatgctaagtgtttttcatgtattatcgtttttaatcattatccccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacttaagatgatcccatcaccagagaggtttctctaccattagcttccctcttccggccattcttcacaaagtcatttttctaaattctgtgtcacatacgatgatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaataataattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttgtaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgactccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctatttta

SEQ ID NO: 194527 - DNA, 11183 bp, Homo sapiens
  Payload ID: 18438
  Gene Name: transportin 1
  Uniprot ID: Q92973
  ENST ID: ENST00000337273
  CDS Start-End: 427-3123
acagtctgggcaaccacaccggcgggccgttttgctcacagccccaccgcgccgggcagcgtctgcagctgctgcgtgcgagacccagaggctccggtcagcgcgccggccgcagggagtgcgagcacttgtgagccccgcgccgggccggtgaagtctggtgctgccgagcccgcttagaaagcacggccgcgcgctgtcggacgcaggcccacaggcccagccgacccaggcagcaattttcctagccccgccgccgttgccaaggcgaccgccgccgaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagatgttgcactctgatttttaatgaaaggaaatgagttttctttttccctcttaccccattttggatctagataagccttatgttttttgggatttttttccttgtttttagtttgaggttttgttttgttttttccttagcttacacattagtacacttttgttgttgaacatcatttatttcttaaaacaagtgttttcttatttgtatagtatagtaaaaacctgtttttccacattttaacttaactccttgatgtgttttaaacagttgattataggttctgctgtttgaggataggggacatactattctgtaaaaggaattaaaggcgaaattgtgaatataaaaagttgatgtaaggagagattgcatgagtgtgtatgaatgtatgtcctattaaggcttcctctttatccttcaaacagttaagatttgtaatttggggaattaacatttataagagtaattttttcttcaggttgtaaggcattaatatagttgcatgttactaattaaatgtattaacacatttcagggagtatgtgtgcataactgtcatggttttttttgttttttgtcttgtttttgagatggagtcttgctctgttgcccaggctggagtgcagtggcacagtcttgtctcactgcaacctctgcctcccgggttcaaacgactctcctgcctcagcttcccaagtagttgggattaaggcatgtgccgtcacacccggctaacttttatattttcagtaaagatgggggttcaccatgttggccaggctagtctcgaactcctggcctcaggtgatccacctgtctcggcctctcaaagtgttgggattacagctgtgagccaccatgcctggccttgtcatacagccttttgagatttagaacaggaaagagcctaaaattaaatcagtacaattccaaaacttttaagagaggtgaggcttgggtttctttttctttgttacctggccaagaaaatatttgagaagagagagttctcttgtgttaacaagaaaataaaattgaaacttggacatcatgttctaaaacacagcctcaagagtttaatattccagaattttaggacttaggttgtggggaaaagataattaaagtcatcctaattcttgttcaagattaggaaccaaaagtcttttctaagtcgtcaatattttagtgatactaaagccctatccattttatgcaaatgatctttttcttctcagttcaggtgatgaaaccatcgtaatgataaatgagtaaggctggcttaacaattcttggactggcgggcattcttgtaatgagttcataatcagtatgactccacaatttcacgtgattctttaagaatgattggaaaagtggcagcaggaactacagagctaacttgaatttcctttgtgttctatacagttgaatatggaattaccaaagctctgtcattttaaaaattctttatttctgagttgttaatttgatgtaaaagtgtaagaacccccgaaacatctccattattcagatagacacaaataatgtacacatcacaattagtatatattttttttaattgagaggactctggctctgtctcccagtcttcagtggcacgatatctgctccctgcaacttccgcctcctaggttcaagcaattctcccatctcagcctcccaagtagctgggattacaggcgcacgccaccaggcctggctaatttttttttttttttttttttttttttttttttaggagagagtttggccgtgttggccaggctggtctcgaactcctgacctcgagtgaacacctcgagtggtacgcccacctttgcctcccaaattgctgggattacagttgtgagccaccgcccctggcgacaatttgtaaatttaacgcaatttctaaaccattggcaagaacaatacagagaagagttgttatactgagaccctttaggtttttgtaccagtcaattcttacatgcatgttatggcagtctcactctgatgatttaaatcttaagtattcttttcaagctttgtgttacttcttgaagaacttgaaacaattttaagaaagacaagtgaacagttaaatgaattgtaatacaactacctagtgataactgctgttaatatcctgtgcacatatataaatatatggtgaatttgtgtttttagttatatccagaattgtttgttaatatacatggacatacctacatattattctataagcaatttatgcaactgtcttactgttgttggacattcagaagttttttctaatttttcactcttagaaataaagttttagtgagagtcgcaa

SEQ ID NO: 194528 - DNA, 3028 bp, Homo sapiens
  Payload ID: 18438
  Gene Name: transportin 1
  Uniprot ID: Q92973
  ENST ID: ENST00000506351
  CDS Start-End: 78-2750
gccgggctgccaggagcagttccgccgggtttcactgtccgtgacttccttcggggcacctcaggcagcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaa

SEQ ID NO: 194529 - DNA, 2632 bp, Homo sapiens
  Payload ID: 18438
  Gene Name: transportin 1
  Uniprot ID: Q92973
  ENST ID: ENST00000523768
  CDS Start-End: 67-2613
atttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaaggtattttgatcacaactatagcctccaagggagaattgcagaattggcctgacctcttaccaaaactctgtagcctgttggattctgaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagaatatattcagatgctaatgcctccactgatccagaaatggaacatgttaaaggatgaagataaagatctcttccctttacttgagtgcctatcttcagttgccacagcactgcagtctggattccttccgtactgtgaacctgtgtatcagcgttgtgtaaacctagtacagaagactcttgcacaagccatgctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggataaaatgccagaagttcgacagagttcttttgccctgttaggtgacctcacaaaagcttgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgc

SEQ ID NO: 194530 - DNA, 863 bp, Homo sapiens
  Payload ID: 18438
  Gene Name: transportin 1
  ENST ID: ENST00000520850
  CDS Start-End: 90-500
cagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccaccatccagagaaccgtgcaacaaaaactggaacaacttaatcagtatccagactttaacaactacttgatttttgttcttacaaaattaaaatctgaagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaattttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgata

SEQ ID NO: 194531 - DNA, 752 bp, Homo sapiens
  Payload ID: 18438
  Gene Name: transportin 1
  ENST ID: ENST00000605210
  CDS Start-End: 1-582
tgctttcagcatgttaagccttgtatagctgatttcatgccaatattgggaaccaacctaaatccagaattcatttcagtctgcaacaatgccacatgggcaattggagaaatctccattcaaatgggtatagagatgcagccttatattcctatggtgttgcaccagcttgtagaaatcattaacagacccaacacaccaaagacgttgttagagaatacagcaataacaattggtcgtcttggttacgtttgtcctcaagaggtggcccccatgctacagcagtttataagaccctggtgcacctctctgagaaacataagagacaatgaggaaaaggattcagcattccgtggaatttgtaccatgatcagtgtgaatcccagtggcgtaatccaagattttatatttttttgtgatgccgttgcatcatggattaacccaaaagatgatctcagagacatgttctgtaagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattcta

SEQ ID NO: 194532 - DNA, 4962 bp, Homo sapiens
  Payload ID: 18439
  Gene Name: transportin 2
  Uniprot ID: O14787
  ENST ID: ENST00000356861
  CDS Start-End: 236-2899
gggaagccggttgggcccgatcctcctggcagctagaacgggccgggcgggggaggggggaaccgagcagagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaa

SEQ ID NO: 194533 - DNA, 4993 bp, Homo sapiens
  Payload ID: 18439
  Gene Name: transportin 2
  Uniprot ID: O14787
  ENST ID: ENST00000450764
  CDS Start-End: 739-3402
ggccgggcttggctggctctcattcgaagaggcagcagagacctacctggggactgctttgggcctgattaaggggaatccttagaatttggctaggccacagagggggatatctggcatccactgagcttgaagggcaggaacaggggacaggagagatcaggacgatcgtcttgggagggcgcatctggggaagctcagaaattggactagggcaggaggcctctgggatctggcagaagttaagggcagagtgtcgggggaaggggactcttcagggactgtgcctgcatagaagagaccacgggggccggggcgctatcacggtctggggcggggcccctggatgtggaggcggctgggccctcgcccagccgctgcgagggaggtggaagccttcgggctcggagccggggtcagcggcatgggccaccctgggacgagggctcttcgctgggtcccatgaggatccgccgggccccgccgccgccgcctgtggcccgtttccacatcccccctcccgcgctcccgagcccgcgactgcgcggccgaggatggcgcagctggcggggaccccgcacttgggcgggcgtggatcggaggcctccgcctgtccgccgagggcgttcccgtcgtcatgcggccaccgcggcctcaggggctccacctgggtctcacacggagccccagagacccagcgctgaccccggcccctacctccgcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgtt

SEQ ID NO: 194534 - DNA, 5122 bp, Homo sapiens
  Payload ID: 18439
  Gene Name: transportin 2
  Uniprot ID: O14787
  ENST ID: ENST00000425528
  CDS Start-End: 359-3052
agagggaggcctttacgcatgccttggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacaggtcgcctgacgagtccctctgccattccagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcatcctacaaacggggaggtgggggggacttctggtgggcaagggcccctgggctctaatagggtcatctctggcagcccacttgggccagctacgtgggagggaggaattacacagctgaccgaatccggcttcggatgaggtgagggaggagcaggtcaggaggggggccctcgtagggacgcgtacactcacacggacacacatggccacacgcatgtgcgggtgccataaccggcgaggctgggccagccgctccaccatttccccgactgcatggagacagtagaattagtgaacccctgagttaacccgtaaggccttccgtgtaacctgcatctagagtttaagaagcttctgctgttttgccggaattggcggtgactggggagggctgggtgggtggggggcctcaggcgggatctcggggcggggggaggaggatggtgaccttgggagtcgccctgtcagcacgcacatgcttgggacccactccacacactccctgccagctttgttgcagcctcagctggtggtgtctccgtccttatcctagcctagctcgcagggtgagaaccactggagtggctggggctggccagaggtcaccgtttctccttcctgtgtgctccagtggcttttgaagacactgggttgggacctttttcctgaagagagctgggtgtagccagagctactggcacctaccccgagcatctctctctgtaagcagcttcaggggcagtccgtttctctgtgcttctgaaacccccttctcacgtttcaggccccagttttaactcaaggcctggggcaggggcgtttaattgatgatgacagaggacacaggtttttgccagcaaaaaggaaaaccaaggcttggtggaagggaaaggtggtgtgtcccctgttccctattccatctccctgggacttcctgctcatcatagtacccagtgagcccagagatcctactagactgggtcagcaattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactcctta

SEQ ID NO: 194535 - DNA, 3056 bp, Homo sapiens
  Payload ID: 18439
  Gene Name: transportin 2
  Uniprot ID: O14787
  ENST ID: ENST00000588216
  CDS Start-End: 374-3037
atcggagggtgggggagagggaggcctttacgcatgccttggtggcggctttctgcacgtgtttctcagcccaggtttcagtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggcaaagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgcca

SEQ ID NO: 194536 - DNA, 737 bp, Homo sapiens
  Payload ID: 18439
  Gene Name: transportin 2
  ENST ID: ENST00000588491
  CDS Start-End: 1-358
ctgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggtacctgagtcacagtctgccaccccgacccagggagcgcccatttcgtgctccctctccaggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctggg

SEQ ID NO: 194537 - DNA, 547 bp, Homo sapiens
  Payload ID: 18439
  Gene Name: transportin 2
  ENST ID: ENST00000590781
  CDS Start-End: 379-547
cagtaaaagaacagccttgagccttggagggtaaagccacgtttttaaggaacaattcagagctggccaggtcatgcttaacttggatgatctctaatcgcgcgaactgctcttatacccatttgacaagtggggaaactgaggcttcaagtggcaggaggtctcccactttgttatcggcagggcagggaggggaaaccaagacgctacagggtctccagctttttaccatctgctcctctctcaagagaaggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagt

SEQ ID NO: 194538 - DNA, 945 bp, Homo sapiens
  Payload ID: 18439
  Gene Name: transportin 2
  ENST ID: ENST00000586775
  CDS Start-End: 168-497
agagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattgggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaac

SEQ ID NO: 194539 - DNA, 541 bp, Homo sapiens
  Payload ID: 18439
  Gene Name: transportin 2
  ENST ID: ENST00000589337
  CDS Start-End: 286-541
agtccagcggaactggctacctcggaatcccaactgctcctttagggtgtcttccgcgattctccgagtggagttaggcgcctgccgacacttccctaaccttggaggcccgggacttgattttcatgaatgaacggagccgggactgactttgcctacggaaaaacggtgccctactgtcttcagacgtcgcaaggatcaagaagatttctttcttcatgaccctgcccttgccagaatttcctgcgctgttccacctcattcaacttcagcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtgg

SEQ ID NO: 194540 - DNA, 2362 bp, Homo sapiens
  Payload ID: 18439
  Gene Name: transportin 2
  ENST ID: ENST00000585886
  CDS Start-End: 63-2362
ctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaa

SEQ ID NO: 194541 - DNA, 2914 bp, Homo sapiens
  Payload ID: 18439
  Gene Name: transportin 2
  Uniprot ID: O14787
  ENST ID: ENST00000592287
  CDS Start-End: 110-2803
tttttttttttaattctctctctttggctccctccttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattggcattctcatcaccaccatcgcttccaagggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagttcctgcagttcttcaagcactgcagtcccaagatccggtcccacgccatcgcctgcgtgaaccagttcatcatggaccgggcccaggcgctgatggacaatattgacaccttcatcgagcacctatttgccctggctgtggatgatgaccccgaggtgcggaagaatgtgtgccgtgccctggtgatgcttctggaagtgcggattgacaggctcatcccccacatgcacagcatcatccagtacatgctgcagaggacccaggaccatgatgagaacgttgcccttgaggcctgtgagttctggctgacgctggccgagcagcccatctgcaaggaagtcctggcctcccatctggtccagttgatccccatcttggtgaatgggatgaagtactcggaaattgacatcatcctgctcaagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgaggaagtgctcagcggctgcactggacgtcctcgccaatgtcttccgggaggaactgctgccccacctactcccactactcaaaggcctcctcttccaccccgagtgggtggtcaaggagtcgggcatcctggtgctgggcgccattgctgagggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctgggagacctcaccaaagcctgcttcatccatgtcaagccctgtatcgccgagttcatgcccattctgggcaccaacctgaacccagagttcatctccgtctgcaacaacgccacctgggccattggtgaaatctgcatgcagatgggggcagagatgcagccttatgtgcagatggtcctcaacaacctggtggaaatcattaaccgacccaacacacccaagacactgctggaaaacacaggtcgcctgacgagtccctctgccattccagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcaggactttattttcttctgcgatgctgtagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggag

SEQ ID NO: 194542 - DNA, 575 bp, Homo sapiens
  Payload ID: 18439
  Gene Name: transportin 2
  ENST ID: ENST00000587654
  CDS Start-End: 75-404
ttccgcgcgagtctctggagaagccgcagcgcgagttgccgccgctgctgcccggggccggcttgccttgcgccatggactggcagccagacgagcagggcctgcagcaggtcctgcagctgctcaaagactcacagtcgcccaacacagccactcagcgcatcgtgcaggataaactcaaacaactcaatcagtttcctgacttcaacaactacctgattttcgtcctgaccagactcaagtcagaagatgagccaacgcgctctctcagtggcctcatcctcaagaacaacgtgaaggcacactatcagagcttcccaccccctgtggcagacttcatcaaacaggagtgtctcaacaacattggcgatgcctcctcgctcatccgagccaccattgggtgagctgcagatgtggcccgagctgctgccccagctctgcaacctgcttaactcggaggattacaacacttgtgagggagcctttggagccctgcagaagatctgtgaagactcatcagagcttctggacagtgacgccctcaacaggcccctcaacatcatgatccccaagtt

SEQ ID NO: 194543 - DNA, 564 bp, Homo sapiens
  Payload ID: 18439
  Gene Name: transportin 2
  ENST ID: ENST00000589149
  CDS Start-End: 1-354
caagacactgctggaaaacacagccatcaccatcggccgcttgggctacgtgtgcccccaggaggtggcacccatgctgcagcagttcatccggccttggtgcacgtccctcaggaacatcagggacaacgaggagaaggactcagccttccgcggcatctgcatgatgatcggtgtcaacccggggggcgttgtgcagcctcctgggtgagcccgaaggatgaccttcgggacatgttttataagattctccacggcttcaaagaccaagttggggaagataactggcagcagttctctgagcaattcccgccgctgctcaaggagaggctggcggctttctatggggtctaggtgatcatggagactgccaggtttctgtctgcgtcgtcgtcggagggattactggggagtgcgctgcatccggaagtcgctgtgccctggttgaggggggttagggaggagtgagtgggactcaaatccagatgccttccccgtccgtccgtccgtccgtccatccgtccacttgccctcctggcaggtgggtggggccaccatgctcat

SEQ ID NO: 194544 - DNA, 586 bp, Homo sapiens
  Payload ID: 18439
  Gene Name: transportin 2
  ENST ID: ENST00000589572
  CDS Start-End: 1-156
gggaaataccagcacaagaacctgctcatcctctatgacgccattggcaccctggccgactctgtaggccaccacctcaaccagccgggacgtggccgtgacctcgacaggcagacagacagacccggccccgccctcgccctgctcccagtctagtgggggagaaagacagttatgagacagcgtggaatacatccagaagctgatgcccccactgatccagaagtggaatgagctcaaggacgaagacaaggacctcttccccctgctggagtgtctgtcatcggtggccaccgccctgcagagtggcttcctgccttactgtgagcccgtctaccagcgctgtgtcaccctggtgcagaagacactggctcaggccatgatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggactcgatgcctgaggtccggcagagctcctttgccctcctggga

SEQ ID NO: 194545 - DNA, 4153 bp, Homo sapiens
  Payload ID: 18440
  Gene Name: transportin 3
  Uniprot ID: Q9Y5L0
  ENST ID: ENST00000265388
  CDS Start-End: 145-2916
ccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaccagt

SEQ ID NO: 194546 - DNA, 3019 bp, Homo sapiens
  Payload ID: 18440
  Gene Name: transportin 3
  ENST ID: ENST00000471166
  CDS Start-End: 114-2987
gccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccaaagaagccctttagcaatgctgtgtgtcgtcacagcctgttatttggccagaatataacctctgaaatcagtaactgtgagtacttaccgcctgtactcagggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccagg

SEQ ID NO: 194547 - DNA, 3283 bp, Homo sapiens
  Payload ID: 18440
  Gene Name: transportin 3
  Uniprot ID: Q9Y5L0
  ENST ID: ENST00000471234
  CDS Start-End: 375-2954
aaaggtatcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagagccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaa

SEQ ID NO: 194548 - DNA, 3585 bp, Homo sapiens
  Payload ID: 18440
  Gene Name: transportin 3
  ENST ID: ENST00000482320
  CDS Start-End: 683-3256
ctggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagagccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcgcctctttgaaatgtgctgctagtgggagctgcagcttcctcctgctgactctgagccccaggcttcagttgagatggtcctttcagaaatgtggagcttagtccaagcctggatttcagtgggtagcacctggcatctgtggctagaaagtcctatgaagtgttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaa

SEQ ID NO: 194549 - DNA, 4514 bp, Homo sapiens
  Payload ID: 18440
  Gene Name: transportin 3
  ENST ID: ENST00000627585
  CDS Start-End: 404-3277
gtttgtagtgtaccaggcggaagtgtgccaaaggtatcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagagccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccaaagaagccctttagcaatgctgtgtgtcgtcacagcctgttatttggccagaatataacctctgaaatcagtaactgtgagtacttaccgcctgtactcagggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaccagt

SEQ ID NO: 194550 - DNA, 957 bp, Homo sapiens
  Payload ID: 18441
  Gene Name: transthyretin
  Uniprot ID: P02766
  ENST ID: ENST00000237014
  CDS Start-End: 178-621
agacaaggttcatatttgtatgggttacttattctctctttgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaaga

SEQ ID NO: 194551 - DNA, 1040 bp, Homo sapiens
  Payload ID: 18441
  Gene Name: transthyretin
  ENST ID: ENST00000610404
  CDS Start-End: 137-694
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtgagtatacagaccttcgagtcatttgaaacagatggctgtcatggaaatagaatccagacatgttcaagctggtctgaactccagacctcagggttccatcagaatgtagacgtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaagacacattctgt

SEQ ID NO: 194552 - DNA, 556 bp, Homo sapiens
  Payload ID: 18441
  Gene Name: transthyretin
  ENST ID: ENST00000613781
  CDS Start-End: 137-556
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctactactcctattccaccacggctgtcgtcaccaatcccaaggaatga

SEQ ID NO: 194553 - DNA, 4832 bp, Homo sapiens
  Payload ID: 18442
  Gene Name: Treacher Collins-Franceschetti syndrome 1
  Uniprot ID: Q13428
  ENST ID: ENST00000323668
  CDS Start-End: 76-4311
taagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgca

SEQ ID NO: 194554 - DNA, 5095 bp, Homo sapiens
  Payload ID: 18442
  Gene Name: Treacher Collins-Franceschetti syndrome 1
  Uniprot ID: Q13428
  ENST ID: ENST00000377797
  CDS Start-End: 109-4575
gaaagaggagccggaagtgtggcgcgcgaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggtgcaagctcccagtgc

SEQ ID NO: 194555 - DNA, 3400 bp, Homo sapiens
  Payload ID: 18442
  Gene Name: Treacher Collins-Franceschetti syndrome 1
  Uniprot ID: Q13428
  ENST ID: ENST00000394269
  CDS Start-End: 30-2906
aggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccacca

SEQ ID NO: 194556 - DNA, 4272 bp, Homo sapiens
  Payload ID: 18442
  Gene Name: Treacher Collins-Franceschetti syndrome 1
  ENST ID: ENST00000427724
  CDS Start-End: 29-4272
ggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaaga

SEQ ID NO: 194557 - DNA, 4644 bp, Homo sapiens
  Payload ID: 18442
  Gene Name: Treacher Collins-Franceschetti syndrome 1
  Uniprot ID: Q13428
  ENST ID: ENST00000439160
  CDS Start-End: 34-4389
gtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatata

SEQ ID NO: 194558 - DNA, 4825 bp, Homo sapiens
  Payload ID: 18442
  Gene Name: Treacher Collins-Franceschetti syndrome 1
  Uniprot ID: Q13428
  ENST ID: ENST00000445265
  CDS Start-End: 82-4320
gaggtctaagggcgcgagggaagtggcgggcggggactaaggcggggcgtgcaggtagccggccggccgggggtcgcgggtatggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcggggaggctggtccaaggagaaagtggaccagctcccatgacctcaccccactcccccaacacaggacgcttcatatagatgtgtacagtatatgtatttttttaagtgacctcctctccttccacagaccccacatgcccaaaggcctcgggacttcccaccaccttgctccacagatccagctaggcctgacctgtgcctcatcccgtgccgctcggtctctggctgatcccgaggctttgtcttcctctcgtcagttcttttggttgtgttttttgttttttttttaataactcaaaaaaaaaataaaagacttggaggaagggt

SEQ ID NO: 194559 - DNA, 4467 bp, Homo sapiens
  Payload ID: 18442
  Gene Name: Treacher Collins-Franceschetti syndrome 1
  Uniprot ID: Q13428
  ENST ID: ENST00000504761
  CDS Start-End: 1-4467
atggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctgggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatga

SEQ ID NO: 194560 - DNA, 701 bp, Homo sapiens
  Payload ID: 18442
  Gene Name: Treacher Collins-Franceschetti syndrome 1
  ENST ID: ENST00000513538
  CDS Start-End: 1-203
agcaggatgactcagggagcagcagcgaggaatcagacagtgatggggaggcaccggcagctgtgacctctgcccaggacagtaactccaaacctgccagaagcaagaccctggccccagcacccccagagaggaacacggaggggtcctcggagagcagtgaggaagagctgccactgacccaggaccaggagtcttcttgaatcccatgagctctgcccaggaccctctctcaagcacctgtggcataccttcatgtgctccactgcacccagagcttaagccacagtcctgctcaggctacacctccaagggtgggaccaggcccaccttatcttcctgtactccagaggcccaagtcagccatgctggtgtggtccaagcttctgtgtgaaccctggcccttccatcagacagcattaccctttgtcctcctctagccccaagctcccagaagcttctgccaggcacctcagagcaccagctcccctgtcccagggcctaaccacagatcctggagttctgcaacctccagaccagagcggtctcatgaaccacctccccttgaatatcacataccacattgttatcaattcatcagtaaggtcagatgctgtttgcacacctccagcaatagggtgctcactgcctctcactttccaatggcacagattacaaaagtaaagaacaaccaccaccaa

SEQ ID NO: 194561 - DNA, 661 bp, Homo sapiens
  Payload ID: 18442
  Gene Name: Treacher Collins-Franceschetti syndrome 1
  ENST ID: ENST00000515516
  CDS Start-End: 1-567
ctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttgga

SEQ ID NO: 194562 - DNA, 869 bp, Homo sapiens
  Payload ID: 18442
  Gene Name: Treacher Collins-Franceschetti syndrome 1
  ENST ID: ENST00000506767
  CDS Start-End: 1-445
gggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggtgtcaaagaagaacccagcttccctcccactgacccaggctgccctgaaggtcctcgcccagaaagccagtgaggctcagcctcctgttgccaggacccagccttcaagtggggtgagcttggggagccaggggaagcaagcccacggagcgtagaaggtgcaggcgtggccctgcatcgcggcaccagcactcatctgccccatgacctctgcacttggtttgcctccctcggcctcagtggcctaatct

SEQ ID NO: 194563 - DNA, 4646 bp, Homo sapiens
  Payload ID: 18442
  Gene Name: Treacher Collins-Franceschetti syndrome 1
  ENST ID: ENST00000513346
  CDS Start-End: 1-4467
atggccgaggccaggaagcggcgggagctacttcccctgatctaccaccatctgctgcgggctggctatgtgcgtgcggcgcgggaagtgaaggagcagagcggccagaagtgtttcctggctcagcccgtaacccttctggacatctatacacactggcaacaaacctcagagcttggtcggaagcggaaggcagaggaagatgcggcactgcaagctaagaaaacccgtgtgtcagaccccatcagcacctcggagagctcggaagaggaggaagaagcagaagccgaaaccgccaaagccaccccaagactagcatctaccaactcctcagtcctgggggcggacttgccatcaagcatgaaagaaaaagccaaggcagagacagagaaagctggcaagactgggaattccatgccacaccctgccactgggaagacggtggccaaccttctttctgggaagtctcccaggaagtcagcagagccctcagcaaatactacgttggtctcagaaactgaggaggagggcagcgtcccggcctttggagctgctgccaagcctgggatggtgtcagcgggccaggccgacagctccagcgaggacacctccagctccagtgatgagacagacgtggaggggaaaccctcagtaaaaccagcccaggtcaaagcctcatcagtttctactaaggagtctccagcaagaaaggcggccccagcccctgggaaggtgggggatgtgacaccccaggtcaaaggaggggccctgcccccagccaagagggccaagaagccagaagaggagtcagagagtagtgaggagggatctgaaagtgaggaggaggcccctgcagggacacgaagccaggtaaaggcctctgaaaaaattctccaggtcagagctgcctcagcccctgccaaggggacccctgggaaaggggctaccccagcaccccctgggaaggcaggggctgtagcctcccagaccaaggcagggaagccagaggaggactcagagagcagcagcgaggagtcatctgacagtgaggaggagacgccagctgccaaggccctgcttcaggcgaaggcctcaggaaaaacctctcaggtcggagctgcctcagcccctgccaaggagtcccccaggaaaggagctgccccagcgccccctgggaagacagggcctgcagttgccaaggcccaggcggggaagcgggaggaggactcgcagagcagcagcgaggaatcggacagtgaggaggaggcgcctgctcaggcgaagccttcagggaaggccccccaggtcagagccgcctcggcccctgccaaggagtcccccaggaaaggggctgccccagcacctcctaggaaaacagggcctgcagccgcccaggtccaggtggggaagcaggaggaggactcaagaagcagcagcgaggagtcagacagtgacagagaggcactggcagccatgaatgcagctcaggtgaagcccttggggaaaagcccccaggtgaaacctgcctctaccatgggcatggggcccttggggaaaggcgccggcccagtgccacccgggaaggtggggcctgcaaccccctcagcccaggtggggaagtgggaggaggactcagagagcagtagtgaggagtcatcagacagcagtgatggagaggtgcccacagctgtggccccggctcaggaaaagtccttggggaacatcctccaggccaaacccacctccagtcctgccaaggggccccctcagaaggcagggcctgtagccgtccaggtcaaggctgaaaagcccatggacaactcggagagcagcgaggagtcatcggacagtgcggacagtgaggaggcaccagcagccatgactgcagctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaaaacctcagtaaagaaaacccaggccaaagccaacccagctgccgccagagcaccttcagcaaaagggacaatttcagcccctggaaaagttgtcactgcagctgctcaagccaagcagaggtctccatccaaggtgaagccaccagtgagaaacccccagaacagtaccgtcttggcgaggggcccagcatctgtgccatctgtggggaaggccgtggctacagcagctcaggcccagacagggccagaggaggactcagggagcagtgaggaggagtcagacagtgaggaggaggcggagacgctggctcaggtgaagccttcagggaagacccaccagatcagagctgccttggctcctgccaaggagtcccccaggaaaggggctgccccaacacctcctgggaagacagggccttcggctgcccaggcagggaagcaggatgactcagggagcagcagcgaggaatcagacagtgatggggaggcaccggcagctgtgacctctgcccagaaggacagtaactccaaacctgccagaagcaagaccctggccccagcacccccagagaggaacacggaggggtcctcggagagcagtgaggaagagctgccactgacccaggtgattaaaccccctctgatttttgtcgaccctaatcgtagtccagctggcccagctgctacacccgcacaagcccaggctgcaagcaccccgaggaaggcccgagcctcggagagcacagccaggagctcctcctccgagagcgaggatgaggacgtgatccccgctacacagtgcttgactcctggcatcagaaccaatgtggtgaccatgcccactgcccacccaagaatagcccccaaagccagcatggctggggccagcagcagcaaggagtccagtcggatatcagatggcaagaaacaggagggaccagccactcaggttgacagtgctgtgggaacactccctgcaacaagtccccagagcacctccgtccaggccaaagggaccaacaagctcagaaaacctaagcttcctgaggtccagcaggccaccaaagcccctgagagctcagatgacagtgaggacagcagcgacagttcttcagggagtgaggaagatggtgaagggccccagggggccaagtcagcccacacgctggtaggtcccaccccctccaggacagagaccctggtggaggagaccgcagcagagtccagcgaggatgatgtggtggcgccatcccagtctctcctctcaggttatatgacccctggactaaccccagccaattcccaggcctcaaaagccactcccaagctagactccagcccctcagtttcctctactctggccgccaaagatgacccagatggcaagcaggaggcaaagccccaacaggcagcaggcatgttgtcccctaaaacaggtggaaaagaggctgcttcaggcaccacacctcagaagtcccggaagcccaagaaaggggctgggaacccccaagcctcaaccctggcgctgcaaagcaacatcacccagtgcctcctgggccaaccctggcccctgaatgaggcccaggtgcaggcctcagtggtgaaggtcctgactgagctgctggaacaggaaagaaagaaggtggtggacaccaccaaggagagcagcaggaagggctgggagagccgcaagcggaagctatcgggagaccagccagctgccaggacccccaggagcaagaagaagaagaagctgggggccggggaaggtggggaggcctctgtttccccagaaaagacctccacgacttccaaggggaaagcaaagagagacaaagcaagtggtgatgtcaaggagaagaaagggaaggggtctcttggctcccaaggggccaaggacgagccagaagaggagcttcagaaggggatggggacggttgaaggtggagatcaaagcaacccaaagagcaagaaggagaagaagaaatccgacaagagaaaaaaagacaaagaaaaaaaagaaaagaagaagaaagcaaaaaaggcctcaaccaaagattctgagtcaccgtcccagaagaaaaagaagaaaaagaagaagacagcagagcagactgtatgacgagcaccagcaccaggcacagggatttcctagccgagcagtggccatccccatgcctctgacctccaccgacctctgcccaccatgggttggaactaaactgttaccttccctcgctccacagaagaagacagccagcttcaggggtccctgtgctggccaagccagtgagcctgcgg

SEQ ID NO: 194564 - DNA, 551 bp, Homo sapiens
  Payload ID: 18443
  Gene Name: trefoil factor 1
  Uniprot ID: P04155
  ENST ID: ENST00000291527
  CDS Start-End: 100-354
taacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 194565 - DNA, 737 bp, Homo sapiens
  Payload ID: 18444
  Gene Name: trefoil factor 2
  Uniprot ID: Q03403
  ENST ID: ENST00000291526
  CDS Start-End: 172-561
acagctgcctcttgcctcctcttcgcctccacggtggaagggctggggccacggggcagagaagaaaggttatctctgcttgttggacaaacagaggggagattataaaacatacccggcagtggacaccatgcattctgcaagccaccctggggtgcagctgagctagacatgggacggcgagacgcccagctcctggcagcgctcctcgtcctggggctatgtgccctggcggggagtgagaaaccctccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatacttcatgaaatcctgggttttcttaaccatcttttcctcattttcaatggtttaacatataatttctttaaataaaacccttaaaatctgctaaa

SEQ ID NO: 194566 - DNA, 407 bp, Homo sapiens
  Payload ID: 18445
  Gene Name: trefoil factor 3 (intestinal)
  ENST ID: ENST00000291525
  CDS Start-End: 1-225
atgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgaggaagcaggcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccg

SEQ ID NO: 194567 - DNA, 452 bp, Homo sapiens
  Payload ID: 18445
  Gene Name: trefoil factor 3 (intestinal)
  ENST ID: ENST00000398431
  CDS Start-End: 1-376
ggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctga

SEQ ID NO: 194568 - DNA, 1109 bp, Homo sapiens
  Payload ID: 18445
  Gene Name: trefoil factor 3 (intestinal)
  ENST ID: ENST00000518498
  CDS Start-End: 236-520
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggca

SEQ ID NO: 194569 - DNA, 2771 bp, Homo sapiens
  Payload ID: 18446
  Gene Name: trehalase (brush-border membrane glycoprotein)
  Uniprot ID: O43280
  ENST ID: ENST00000264029
  CDS Start-End: 47-1798
gccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagttcctgccttcccctgcctcttcatgccctcctacctcccagcctgtcctcagagcgaagtggagggcagggtcacgacctggaggtcatgggtaggggcctagctccctcctggaaccttgaatagggtggaaatcctgctctggagggaagacctatccccaagtgcctcagcgccaagccccacaccggccttccactcacttccgtagtccaaaggctttattgttctgctgaaatgcttacaaatactgaaaacccccagcctgggcccaggcaaccaagggctcaatgctgggaaggagagcaggggaggtgggcttagtgttaaggcgtgaagggcgaggccagacagctggaggcctggtcctccactctccatttccatcacccttcggaggctgaaggaagggcggcggcaccacagggcccttcccctctgctgcatcatctcctgctcaggctttctctctaggagcattggaggaatcctctttccctgtcggaaactcaacactgtacagaactccaaccataacccttctagcttcctctcccaactgcatcgctcctcctctgttccatagatcccccggcttcatcccttctggctctaagcaaggcaccagtggaagggagagggctggactggggggctggcagcctgtgcatcagggctgaagacacaggcagggggaaggaaaaaggtattcagtcccttccccccagcatgagatgcccaggggcctgggctggagagatgatggcacgtaccctcagatggcccacagctgaagcagtgggctgggccacagagctgcagcaattagtatgtaaccatggcaatgaagcagtcactatggtaaccatggtgatgagtctgcaactaggggatggagctgggacctcaaggttga

SEQ ID NO: 194570 - DNA, 1718 bp, Homo sapiens
  Payload ID: 18446
  Gene Name: trehalase (brush-border membrane glycoprotein)
  Uniprot ID: O43280
  ENST ID: ENST00000397925
  CDS Start-End: 40-1698
gtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatctactcagaacatcccttcattgtgcctggcggtcgctttgttgagttctactactgctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacct

SEQ ID NO: 194571 - DNA, 1723 bp, Homo sapiens
  Payload ID: 18446
  Gene Name: trehalase (brush-border membrane glycoprotein)
  ENST ID: ENST00000613915
  CDS Start-End: 24-137
attcagtcacagtcacagccaccatgccagggaggacctgggagctgtgcctgctactgctgctggggctgggactggggtcccaggaggccctacccccaccctgtgagagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaaggtatcagcgtcctgggcctgcccaaggcctgaccaagggaactgaagagaggaatgtgcctggggcccacagtgtcttcggagcacagatcagggactcctactgggtcatggagggtctgctcctctcagagatggctgagacggtgaagggcatgctgcagaacttcttggacctggtgaaaacctatgggcatgtccccaatggtgggcgcgtgtactacctgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagt

SEQ ID NO: 194572 - DNA, 4770 bp, Homo sapiens
  Payload ID: 18447
  Gene Name: triadin
  Uniprot ID: Q13061
  ENST ID: ENST00000334268
  CDS Start-End: 319-2508
ctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaaaaacctgcaagagtatcaaaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaaacacacatgtatgacccttacaagtgctttaagattttaaaaatgtgatgttttgtccacagtagttcaggcaattaagaatatgcaacccagagaatttctgtgaaaacattttgctctttggcctggtgtggacggaaagggtggccaaatggattgagtgatgagcagacatgtttaagggtctaagtctcaagaatctgttatgtgtgtttgctgcggtgggagggggtgcttgtatttatcttatttccagtcactataaggttgtacacaaactaatttaaagtttacttaataatggtatctttaaaataattgacacaattgcaaaatgaattcctggcttcagttagctattatttttttaatgacaacatagactgtgctctaagtttaaaagatggggaagcttatataaaagtgacccttttgcatcatatgggtatctaaacttaatttacccaataagttgatgcttaatgattttattttatttttgtctatttctattttagttgtggctttgctctaagaatgggtaatagttgtactacagactgctataaatttcttgtgatactcttttagagctcaaaatatctctgagctttagacatggtaaggtggagagtaaatgcttgataaatctttaagatatgtcttgaatgataattaggacattcagtccagtggaaatacaccattcaattagtcaggtctggtgaatcgtttgtttaaaatattagcaaatgagatgtggaattctgaaatttctccagactgtgtcttaataaaaatgtcacctgggtgaaattttagatcaatcactaaatttgggtgacaaatataaaaatattttcatttcactttaatacattctttctgtgaagtaaaatgtttttctttctcataatggcaaaatatgaatgccatcaaagtttaaggaattcattttagccttaaatgccttcgtgagatgtcttacttgtattttaggtaactggtcatcagtgccaatgacatggataacaatttttaatctactcgacagtgcatccctgggaatgactgttatgtttttgtcatattcctggtaatataaatactcgtgttctttactacattgtttttatcaactctaaaagtcatgcctctgtgacctttatcatgtttacaattgcaactgaacttatgacaaattaactcaggaaataaattgagttatcctttctagcattgtaattaccatcagcaaggcctgagatagccagagccaatactagccaagtgatttattttcaaggattgccactaactacggttctttaggaccaagatataaaacagtcactaaaaatcattaggctaggtatcagtaatacattcattactaataatgcatttttggagacttttgtgaaagaagttggtctctgccaaaagctggtggaccacattcacaccacgaaagccagtgtcacatgaaccagattaatgactctctttatggggtatgtgggacatcctggaagtgtataatttcaggaatgaccagacaataccatcttgcaaagccccttcaggtgacaatctaaacttgtgggtaggagagtgcataaagtttattgctcaactgctcctccagcctgctgaatttactgagtaaagaaatagcaaatatgatagatgttttagatttcatagaacagaatggtttgtccattaattctttcattcaatgactgtttattgaatacctactcttttagggcgctgtgttaggtgctgtattgtacaagaaaaatataataaattagattcccagcgctattctgacatagtgaatgaccttgaaaaatttactaaacatactatgtttgtttctccatgagtaaaatagggatatagggacaaacagtctaatatctcatagaaataccatggagacaaataaaatattttaatataaatatgatattaaagtaaatttctgaagtaatacttttgggtatggcactagtttttcctctgactattttactgtttctttcactctcaatataaaaactatttgataagataaaacgatatattttattgtaattagaatttagacaaatcagctataatgtaaaaatgttaataataattacgttttatctgattaaagttacaatgatcatagcactttaaaaatattatctgaactgtcatttgtttatatattaccgtctaataaaatagttatagatcttccaa

SEQ ID NO: 194573 - DNA, 766 bp, Homo sapiens
  Payload ID: 18447
  Gene Name: triadin
  ENST ID: ENST00000361029
  CDS Start-End: 1-455
ttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaaaatacatctaaatttttggaactttatgagttttggcctgcccttatttaggtattaatgaaaaagattatatttttatatcttcttcaataactatatttattttttaaagacctaacagaatttcataataaaatggattcctctaaaaatgctgttactactctaaaaagaacgagatttacaaaaatccttagaggtgtatctgtttagtaacaagctttgttatttcatatgtttgatatgcataatttggagcaattaagaatgtaacatgttgcttaaattcaataaactctcttggtcctaaa

SEQ ID NO: 194574 - DNA, 776 bp, Homo sapiens
  Payload ID: 18447
  Gene Name: triadin
  ENST ID: ENST00000422596
  CDS Start-End: 1-134
aaatacacaaagataagactgaaaaacaagagaaacctgaaaggaaaatacaaactaaagattggtcagccaattcttcaacaatcagaacattgaagctcactcagttgaaacctatttatatttgtacttaggaaactaatgtctccttactgttctctttccttttttcggttcttaattcctttgatcacagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaa

SEQ ID NO: 194575 - DNA, 1294 bp, Homo sapiens
  Payload ID: 18447
  Gene Name: triadin
  Uniprot ID: Q13061
  ENST ID: ENST00000542443
  CDS Start-End: 198-701
gtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaa

SEQ ID NO: 194576 - DNA, 1179 bp, Homo sapiens
  Payload ID: 18447
  Gene Name: triadin
  ENST ID: ENST00000546248
  CDS Start-End: 319-1179
ctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggtaaacattcagagcaggaggctgccggaggttctaagagaatattgggcaagaagcacatgcagtga

SEQ ID NO: 194577 - DNA, 1661 bp, Homo sapiens
  Payload ID: 18447
  Gene Name: triadin
  Uniprot ID: Q13061
  ENST ID: ENST00000628709
  CDS Start-End: 135-1028
gaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggacaaagcccagccattccacctcccttaccgacagaacaagcttccagacccactccggcatcacctgcccttgaaggcaagtacttttttttttcttaaagatctctattgtagataaaatagaatgtagaggaacagcaacaacaaaaatagtcacaaagaaacagcaaaatccaatattttcttaaatacttttagtatgtctaaactatacttttcctaaaattgcaatttgcttcttttagaaaaccaaaaatgtccccttaagattctatattggtgaccctcagcttccagaaggatgcccactctagcactttgggaatcaagcaaaaaaatatagggacaaatagataaggctatgccttgcaactctgggagttttaccacaacttgatcaatttagtctctgaagaggctggtgccagatttgctgggtttgaatctgagctccaccttttcctagctttgtaaatttggaaagttatttaaattaactcttcatgagttttgccatctctaagatgatataagcagagcactgatctcctagcgttattgtgaggattgaaatatatatatacacacacactcacacacacacaaatactgttttatgtatatgtatagtttataagtactatatacaactggtggttaatactactaataattcttgaaaatatgatgtctcaagatcagctttgtaataaattttgctggaacgttaaa

SEQ ID NO: 194578 - DNA, 3635 bp, Homo sapiens
  Payload ID: 18448
  Gene Name: tribbles pseudokinase 1
  Uniprot ID: Q96RU8
  ENST ID: ENST00000311922
  CDS Start-End: 583-1701
aaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaata

SEQ ID NO: 194579 - DNA, 1409 bp, Homo sapiens
  Payload ID: 18448
  Gene Name: tribbles pseudokinase 1
  ENST ID: ENST00000519576
  CDS Start-End: 264-689
accagtcagccatcgtgctgggggacctgaagcttaggaagttcgtcttctccacggaggagaggtgagcggccgccacagcttctcctgtggccttttggaaccaaagcggaggtgcaggtcatgtagttaggtgctgtgtgttggtgcaaaacaaagtcaagggctcatatgtcccagatttagtatttagagcttctgttcctgaggagtcacagccaagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagatt

SEQ ID NO: 194580 - DNA, 1332 bp, Homo sapiens
  Payload ID: 18448
  Gene Name: tribbles pseudokinase 1
  Uniprot ID: Q96RU8
  ENST ID: ENST00000520847
  CDS Start-End: 255-875
ctactgcccaacccgaatgaaatttcagacgcatgatcaagcccagtttaatagggaggaaaaaaaaaccttttcttctccatgactggggctaagagctgttctgggacaagcatgtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctac

SEQ ID NO: 194581 - DNA, 4391 bp, Homo sapiens
  Payload ID: 18449
  Gene Name: tribbles pseudokinase 2
  Uniprot ID: Q92519
  ENST ID: ENST00000155926
  CDS Start-End: 1420-2451
ggggggggcggaggctccgtggaaatgtgtcggtgacattgaatggggagaccgagcgcgagcgaggcgcgcgcgcgcacacgcgcactcacggccccgctcgctccgagatccccggccacgtaagtaactattaataccgcctcgccgggggatgcgggcgtgctgagcgcggggattggcctcgggcaccgtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctggcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctttgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 194582 - DNA, 2778 bp, Homo sapiens
  Payload ID: 18449
  Gene Name: tribbles pseudokinase 2
  ENST ID: ENST00000381465
  CDS Start-End: 215-838
ggagaccgagcgcgagcgaggcgcgcgcgcgcacacgcgcactcacggccccgctcgctccgagatccccggccacgtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattggttcgtggcaggaagctattagaagtcaaacgtccagatgcattactgctatcttagtttaaagggggaaagaaaagggaagaagaaaggaaaagagaaatccaactcctttttcatgttttgcttttgaacaatgagggtttgtgtgacaggcattcctctttgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcagcaggagccctgtcctcacgttcccaggagggcggcttcacccttcgtaaccaggagacaaggcggccatggatttgcccttgattctattttgctaatggaagatagaaaggagagaaggttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaa

SEQ ID NO: 194583 - DNA, 830 bp, Homo sapiens
  Payload ID: 18449
  Gene Name: tribbles pseudokinase 2
  ENST ID: ENST00000405331
  CDS Start-End: 71-829
agccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagagatgcctctgcccctggagcctggagatgtttcccctggttttgccttcgataccctctgtgatcttggattggtccttcgtctgtttccaccctccccctaccagcctcatatttctccttctgttaccttctgtatgctgtattggctctaaggtcttttcaattaataataaattggtgtatgtgcttctttgaa

SEQ ID NO: 194584 - DNA, 2499 bp, Homo sapiens
  Payload ID: 18450
  Gene Name: tribbles pseudokinase 3
  Uniprot ID: Q96RU7
  ENST ID: ENST00000217233
  CDS Start-End: 554-1630
ggagcttgcagtgagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 194585 - DNA, 1070 bp, Homo sapiens
  Payload ID: 18450
  Gene Name: tribbles pseudokinase 3
  ENST ID: ENST00000449710
  CDS Start-End: 256-1070
ggaagcctctgggcgtctgcgtgttgccgcgtgttacacgcacgcacgccccttacacaccttttcacagaccccgccgtcggggcgcggccaggtcagatcccttttgatccgggcctgggctgagtgctccccccgggcttcaggtgacgcggccccgcggagcgtggggtcgcccgagttgggctggggaagccagggacggaggtgtccggccgtcacccctagaggagggcgtgcgggggtctgttttgcatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaa

SEQ ID NO: 194586 - DNA, 1533 bp, Homo sapiens
  Payload ID: 18450
  Gene Name: tribbles pseudokinase 3
  ENST ID: ENST00000422053
  CDS Start-End: 318-1475
cttacacaccttttcacagaccccgccgtcggggcgcggccaggtcagatcccttttgatccgggcctgggctgagtgctccccccgggcttcaggtgacgcggccccgcggagcgtggggtcgcccgagttgggctggggaagccagggacggaggtgtccggccgtcacccctagaggagggcgtgcgggggtctgttttgcggcacaaagcatgtgcacagccaggtatcatcctgcgtgactcagaacagccttgagatgtaaggagtgtcatcccagcctcgaacctggggagctttctaagactcccaaggatggtacttatgcatcttgctgtgaagaataacaggatgagtgctaataatgaccatttcctgacacctacctggcaacagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaa

SEQ ID NO: 194587 - DNA, 877 bp, Homo sapiens
  Payload ID: 18450
  Gene Name: tribbles pseudokinase 3
  ENST ID: ENST00000615226
  CDS Start-End: 487-877
ggaggccaggaatgagggagtaagtgagccattgactcaatgaatgaatgaatgagcgagtgagtgaaggaaggaagggataagaaatttgaagcccccgcaaagggaggtgacttgtccacaatctcacaggctcagtggcttcagccagacttggaacgcaaccagaagttctaaggcatcatgtcacttttgtgggggaaattcacgctcattctccaccgtgttcttggggaacatgcagcatgttcttttgcctcttccctcaccccagaacaggggttactggacagcggcatcaacttcacctgggaactggatagaaatgcagattcagaccttctgaatgagctactttgggagtagggcccagcaatgtatgttgaaacaggcctccagatgatctcaatgcttgctcaagtttgagaaccactgaaccgcagtatgactctccgtgtcacctggctaactctgcctcactttcagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtaccc

SEQ ID NO: 194588 - DNA, 6900 bp, Homo sapiens
  Payload ID: 18451
  Gene Name: trichohyalin
  Uniprot ID: Q07283
  ENST ID: ENST00000368804
  CDS Start-End: 1-5832
atgtctccacttctgagaagcatctgtgacatcactgaaattttcaatcagtatgtctctcatgattgtgatggagcagcattaactaagaaagacctgaagaacctccttgaaagggaatttggagctgtgcttcggagaccacatgaccctaagacggtagatctgatcctggaacttctggatcttgacagtaatgggcgtgtcgatttcaacgaattcctcctatttattttcaaagtggctcaagcttgttactatgctctcggccaggccacgggactggatgaggagaagcgagcccggtgtgacggaaaggagagcctgttacaagatcgcaggcaagaagaagaccaaaggagattcgagccccgggacagacaactggaagaagaacctgggcaacgacgcaggcagaagaggcaggaacaggagagggagctagctgagggagaggagcaaagtgagaaacaagagcgacttgaacagcgcgacaggcagcgccgcgacgaggagctgtggcggcaaaggcaagaatggcaagaacgggaagagcgccgtgcagaggaagagcagctgcagagttgcaaaggtcacgaaactgaggagtttccagacgaagagcaactgcgaaggcgggagctgctggagctgaggaggaagggccgcgaggagaaacagcagcaaaggcgagagcggcaagacagagtgttccaggaggaagaagagaaagagtggaggaagcgcgagacagtgctccggaaggaagaagagaagttgcaggaagaggagccgcagcggcaaagagagctccaggaggaagaagagcagctacggaagctggagcggcaagagctgaggagggagcgccaggaggaagagcagcagcagcaaaggctgaggcgcgagcagcaactaaggcgcaagcaggaggaggagaggcgcgagcagcaggaggagaggcgcgagcagcaggagaggcgcgagcagcaggaggagaggcgcgagcagcagctgaggcgcgagcaggaggagaggcgcgagcagcagctgaggcgcgagcaggaggaggagaggcgcgagcagcagctgaggcgcgagcaggaggaggagaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcaggaggaggagaggcacgagcagaagcacgagcaggagaggcgcgagcagcggctgaagcgcgagcaggaggagaggcgcgattggctgaagcgcgaggaggagacggagaggcacgagcaggagaggcgcaagcagcagctgaagcgcgaccaggaggaggagaggcgcgaacgttggctgaagctcgaggaggaggagaggcgcgagcagcaggagaggcgcgagcagcaactaaggcgggagcaagaggagaggcgcgagcagcggctgaagcgccaggaggaggaagagaggctccagcagcggttgaggagcgagcaacaactaagacgcgagcaggaggagaggcgcgagcagctgctgaagcgcgaggaggagaagaggctcgagcaggagaggcgagagcagcggctgaagcgcgagcaggaggagaggcgcgatcagctgctgaagcgcgaggaggagaggcgccagcagcggctgaagcgcgagcaggaagagaggctcgagcagcgactgaagcgcgaggaggtggagagactcgagcaggaggagaggcgcgagcagcggctgaagcgcgaggagccggaggaagagaggcgccagcagctgctgaagagcgaggagcaggaggagaggcgccagcagcaactaaggcgcgagcagcaggaaaggcgcgagcagcggctgaagcgcgaggaggaggaagagaggctcgagcagcggctgaagcgcgagcatgaggaagagaggcgcgagcaggagctagctgaggaggagcaggaacaggcccgggagcggattaagagccgcatcccgaagtggcagtggcagctagaaagcgaggccgacgcacggcaaagcaaagtctactcgaggccccgcaagcaggaagggcagaggcgccgccaagagcaggaggaaaagaggcggcgccgggagagtgagctgcaatggcaggaggaggaacgggctcaccggcagcagcaggaagaggagcagcgccgggacttcacatggcagtggcaggcggaggaaaagagcgagaggggccgtcagaggctgtcggccaggcccccattgcgggagcagcgggagaggcagctgagggccgaggagcgccagcagcgggaacaacggtttctcccggaggaggaggagaaggagcagcggcgccgccagcgacgcgagagggagaaagagctgcagttcctggaggaagaggagcagctccagcggcgggagcgtgcccaacagctccaggaggaggaggacggcctccaggaggatcaggagaggaggcgaagccaggagcagcgccgcgaccaaaaatggaggtggcaactagaagaagaaaggaagagacgccgccacacgctgtacgccaagccagccctacaagagcagctgaggaaggaacagcagctgctgcaggaggaggaggaggagctacagagagaggagcgcgagaagagaaggcgccaagaacaggagagacaataccgcgaggaagagcagctgcagcaggaggaagagcagctgctgagagaggaacgggagaaaagaagacgccaggagcgggaaaggcaatatcggaaggataagaagctgcagcagaaggaagagcagctgctgggagaggaaccggagaagagaaggcgccaggagcgggagaaaaaataccgcgaggaagaggagttgcagcaggaggaagagcagctgctgagagaggaacgggagaagagaaggcgccaggagtgggagaggcagtaccgcaaaaaagacgagctgcagcaggaagaagagcagctgctgagagaggaacgggagaaaagaagactccaggagcgggagaggcaatatcgggaggaagaggagctgcagcaggaggaagagcagctgctgggagaggaacgggagacgagaaggcgccaggagctggagaggcaatatcggaaggaagaggagctgcagcaggaggaagagcagctgctgagagaggaaccggagaagagaaggcgccaggagcgggagaggcaatgtcgggaggaagaggagctgcagcaggaggaagagcagctgctgagagaggaacgggagaagagaaggcgccaggagctggagaggcaatatcgggaggaagaggaggtgcagcaggaggaagagcagctgctgagagaggaaccggagaagagaaggcgccaggagctggagaggcaataccgcgaggaagaggagctgcagcaggaggaagagcagctgctgagagaggaacaggagaaaaggcgccaggagcgggagaggcagtatcgggaggaggaagagcttcagcgccagaaaaggaagcagcgataccgggatgaggatcagcgcagtgatctgaaatggcagtgggaaccagaaaaagaaaatgcagttcgtgataacaaggtttactgcaaaggcagagagaatgaacagttccggcagttggaagattcccagctgcgcgacagacaatcccagcaagatctgcagcacctgctgggtgaacagcaagagcgagatcgtgagcaagagaggaggcgctggcagcagcgcgacaggcatttcccagaggaagaacagctggagcgagaagagcaaaaggaagccaaaaggcgcgacaggaagtcccaagaggaaaagcagttgctgagagaggaaagagaagagaagagacgccgtcaagagacagacagaaaattccgcgaggaggaacagctgctccaggaaagggaggaacagccgctgcgccgccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctgccaggagcgcgagcaacagctgcgtcaggaccgcgacagaaaattccgcgaggaggaacagcagctgagccgccaagagcgtgacagaaaattccgtgaagaggaacagcaggtgcgccgccaggaacgagagagaaaattcctggaggaggaacagcagctgcgccaggagcgtcacagaaaattccgcgaagaggaacagctgctccaggaaagggaagaacagcagctgcaccgccaagagcgtgacagaaaattcctggaggaggaacaacagctgcgccgccaagagcgtgacagaaaattccgcgaacaggaactgcgcagtcaggaaccagagagaaaattcctcgaggaggaacagcagctgcaccgccagcaacggcagagaaaattcctccaggaggaacagcagctgcgccgccaggagcgcgggcaacagcggcgtcaggaccgtgacagaaaattccgcgaggaggaacagctgcgccaggagagggaggaacagcagctgagccgccaagagcgtgacagaaaattccgtttagaggaacagaaagtgcgccgccaggaacaagagagaaaattcatggaggacgaacagcagctgcgccgccaggagggccaacaacagctgcgccaggagcgcgacagaaaattccgcgaagacgaacagctgctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagataaaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttcgagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcagatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggcaagtaa

SEQ ID NO: 194589 - DNA, 6995 bp, Homo sapiens
  Payload ID: 18451
  Gene Name: trichohyalin
  Uniprot ID: Q07283
  ENST ID: ENST00000614923
  CDS Start-End: 96-5927
gttacccagtacacttgcctgtggtgtcagcaagcactgtcgacttcttcctctggtgaagtgggtttacttgaacttgaaggaaagaaaaaaaaatgtctccacttctgagaagcatctgtgacatcactgaaattttcaatcagtatgtctctcatgattgtgatggagcagcattaactaagaaagacctgaagaacctccttgaaagggaatttggagctgtgcttcggagaccacatgaccctaagacggtagatctgatcctggaacttctggatcttgacagtaatgggcgtgtcgatttcaacgaattcctcctatttattttcaaagtggctcaagcttgttactatgctctcggccaggccacgggactggatgaggagaagcgagcccggtgtgacggaaaggagagcctgttacaagatcgcaggcaagaagaagaccaaaggagattcgagccccgggacagacaactggaagaagaacctgggcaacgacgcaggcagaagaggcaggaacaggagagggagctagctgagggagaggagcaaagtgagaaacaagagcgacttgaacagcgcgacaggcagcgccgcgacgaggagctgtggcggcaaaggcaagaatggcaagaacgggaagagcgccgtgcagaggaagagcagctgcagagttgcaaaggtcacgaaactgaggagtttccagacgaagagcaactgcgaaggcgggagctgctggagctgaggaggaagggccgcgaggagaaacagcagcaaaggcgagagcggcaagacagagtgttccaggaggaagaagagaaagagtggaggaagcgcgagacagtgctccggaaggaagaagagaagttgcaggaagaggagccgcagcggcaaagagagctccaggaggaagaagagcagctacggaagctggagcggcaagagctgaggagggagcgccaggaggaagagcagcagcagcaaaggctgaggcgcgagcagcaactaaggcgcaagcaggaggaggagaggcgcgagcagcaggaggagaggcgcgagcagcaggagaggcgcgagcagcaggaggagaggcgcgagcagcagctgaggcgcgagcaggaggagaggcgcgagcagcagctgaggcgcgagcaggaggaggagaggcgcgagcagcagctgaggcgcgagcaggaggaggagaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcagcagctgaggcgcgagcaggaggaggagaggcacgagcagaagcacgagcaggagaggcgcgagcagcggctgaagcgcgagcaggaggagaggcgcgattggctgaagcgcgaggaggagacggagaggcacgagcaggagaggcgcaagcagcagctgaagcgcgaccaggaggaggagaggcgcgaacgttggctgaagctcgaggaggaggagaggcgcgagcagcaggagaggcgcgagcagcaactaaggcgggagcaagaggagaggcgcgagcagcggctgaagcgccaggaggaggaagagaggctccagcagcggttgaggagcgagcaacaactaagacgcgagcaggaggagaggcgcgagcagctgctgaagcgcgaggaggagaagaggctcgagcaggagaggcgagagcagcggctgaagcgcgagcaggaggagaggcgcgatcagctgctgaagcgcgaggaggagaggcgccagcagcggctgaagcgcgagcaggaagagaggctcgagcagcgactgaagcgcgaggaggtggagagactcgagcaggaggagaggcgcgagcagcggctgaagcgcgaggagccggaggaagagaggcgccagcagctgctgaagagcgaggagcaggaggagaggcgccagcagcaactaaggcgcgagcagcaggaaaggcgcgagcagcggctgaagcgcgaggaggaggaagagaggctcgagcagcggctgaagcgcgagcatgaggaagagaggcgcgagcaggagctagctgaggaggagcaggaacaggcccgggagcggattaagagccgcatcccgaagtggcagtggcagctagaaagcgaggccgacgcacggcaaagcaaagtctactcgaggccccgcaagcaggaagggcagaggcgccgccaagagcaggaggaaaagaggcggcgccgggagagtgagctgcaatggcaggaggaggaacgggctcaccggcagcagcaggaagaggagcagcgccgggacttcacatggcagtggcaggcggaggaaaagagcgagaggggccgtcagaggctgtcggccaggcccccattgcgggagcagcgggagaggcagctgagggccgaggagcgccagcagcgggaacaacggtttctcccggaggaggaggagaaggagcagcggcgccgccagcgacgcgagagggagaaagagctgcagttcctggaggaagaggagcagctccagcggcgggagcgtgcccaacagctccaggaggaggaggacggcctccaggaggatcaggagaggaggcgaagccaggagcagcgccgcgaccaaaaatggaggtggcaactagaagaagaaaggaagagacgccgccacacgctgtacgccaagccagccctacaagagcagctgaggaaggaacagcagctgctgcaggaggaggaggaggagctacagagagaggagcgcgagaagagaaggcgccaagaacaggagagacaataccgcgaggaagagcagctgcagcaggaggaagagcagctgctgagagaggaacgggagaaaagaagacgccaggagcgggaaaggcaatatcggaaggataagaagctgcagcagaaggaagagcagctgctgggagaggaaccggagaagagaaggcgccaggagcgggagaaaaaataccgcgaggaagaggagttgcagcaggaggaagagcagctgctgagagaggaacgggagaagagaaggcgccaggagtgggagaggcagtaccgcaaaaaagacgagctgcagcaggaagaagagcagctgctgagagaggaacgggagaaaagaagactccaggagcgggagaggcaatatcgggaggaagaggagctgcagcaggaggaagagcagctgctgggagaggaacgggagacgagaaggcgccaggagctggagaggcaatatcggaaggaagaggagctgcagcaggaggaagagcagctgctgagagaggaaccggagaagagaaggcgccaggagcgggagaggcaatgtcgggaggaagaggagctgcagcaggaggaagagcagctgctgagagaggaacgggagaagagaaggcgccaggagctggagaggcaatatcgggaggaagaggaggtgcagcaggaggaagagcagctgctgagagaggaaccggagaagagaaggcgccaggagctggagaggcaataccgcgaggaagaggagctgcagcaggaggaagagcagctgctgagagaggaacaggagaaaaggcgccaggagcgggagaggcagtatcgggaggaggaagagcttcagcgccagaaaaggaagcagcgataccgggatgaggatcagcgcagtgatctgaaatggcagtgggaaccagaaaaagaaaatgcagttcgtgataacaaggtttactgcaaaggcagagagaatgaacagttccggcagttggaagattcccagctgcgcgacagacaatcccagcaagatctgcagcacctgctgggtgaacagcaagagcgagatcgtgagcaagagaggaggcgctggcagcagcgcgacaggcatttcccagaggaagaacagctggagcgagaagagcaaaaggaagccaaaaggcgcgacaggaagtcccaagaggaaaagcagttgctgagagaggaaagagaagagaagagacgccgtcaagagacagacagaaaattccgcgaggaggaacagctgctccaggaaagggaggaacagccgctgcgccgccaagagcgtgacagaaaattccgcgaagaggaactgcgccatcaggaacaagggagaaaattcctcgaggaggaacagcggctgcgccgccaggaacgggagagaaaattccttaaggaggaacagcagctgcgctgccaggagcgcgagcaacagctgcgtcaggaccgcgacagaaaattccgcgaggaggaacagcagctgagccgccaagagcgtgacagaaaattccgtgaagaggaacagcaggtgcgccgccaggaacgagagagaaaattcctggaggaggaacagcagctgcgccaggagcgtcacagaaaattccgcgaagaggaacagctgctccaggaaagggaagaacagcagctgcaccgccaagagcgtgacagaaaattcctggaggaggaacaacagctgcgccgccaagagcgtgacagaaaattccgcgaacaggaactgcgcagtcaggaaccagagagaaaattcctcgaggaggaacagcagctgcaccgccagcaacggcagagaaaattcctccaggaggaacagcagctgcgccgccaggagcgcgggcaacagcggcgtcaggaccgtgacagaaaattccgcgaggaggaacagctgcgccaggagagggaggaacagcagctgagccgccaagagcgtgacagaaaattccgtttagaggaacagaaagtgcgccgccaggaacaagagagaaaattcatggaggacgaacagcagctgcgccgccaggagggccaacaacagctgcgccaggagcgcgacagaaaattccgcgaagacgaacagctgctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagataaaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttcgagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcagatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggcaagtaa

SEQ ID NO: 194590 - DNA, 3603 bp, Homo sapiens
  Payload ID: 18452
  Gene Name: trichohyalin-like 1
  Uniprot ID: Q5QJ38
  ENST ID: ENST00000368806
  CDS Start-End: 66-2780
acagcccgctgccccacgttctacctgctctcgcttgtgaactagcctctcctgagtttgtaaagatgcctcagctcctgagaaatgtcctctgtgtaattgagacattccacaaatatgccagtgaggacagtaacggggcaacactgactggcagagagctgaaacaactcatccagggcgagtttggggacttttttcagccctgtgtccttcatgctgtggaaaaaaattcaaatcttctgaatattgacagtaatggcatcatcagttttgatgaatttgttcttgcaatcttcaacttgttgaacctctgttatcttgacataaaatcattactaagttctgaactaagacaggtgactaaaccagagaaggagaagctagatgatgtggatgttcaggcaaccaccggagatggtcagtggacagtgggaacttcaccaactcaagaaaagaggatgcttccttcaggaatggcatcatcatctcagctcatccctgaagaaagtggagcagttggaaataacagagtggacccatggagagaagccaagactcacaactttccaggagaagcatctgaacacaatgatcctaagaacaaacacctggaaggagatgaacaaagtcaggaagtggctcaagatatacaaacaacagaagacaatgaaggccaacttaagacaaataagccaatggcaggatcaaaaaagaccagcagtcccacagagaggaagggacaagataaggagatctcccaggaaggagatgaaccagccagagagcaaagtgtttccaagataagagaccagtttggagaacaggaaggaaacttggcaacccaaagttcaccaccaaaagaagcaacacaaagaccatgtgaagatcaggaagttagaacagaaaaggaaaaacactctaatatacaagaaccacccctacaaagagaagatgagcccagttcacagcatgctgacctgccagaacaagctgctgccaggtcaccatctcagacacagaaatcaactgattccaaggatgtctgtagaatgtttgacactcaagaaccaggaaaggatgctgaccagacaccagctaaaacaaagaatttgggtgaacctgaggattatggcagaacatctgagacccaagaaaaagaatgtgaaacaaaggacctgccagtccaatatggtagcagaaatggttcagaaacatctgacatgagagatgaaaggaaagagaggagaggtcctgaggcccatggaacagcagggcagaaagaacgtgacagaaaaactcggccactagtcctggaaacccaaacacaggatgggaagtatcaggaactccaaggattatcaaaatcaaaagatgctgaaaaaggttctgagacacaatatctaagctcagaaggaggagatcagactcaccctgaacttgaaggaacagcagtctcaggagaagaggcagaacacaccaaagaaggcacagcagaagcatttgtgaacagcaaaaacgcacctgcagcagaaaggacactgggggcaagagaaagaacacaagatttagcaccacttgagaagcagtctgtaggagaaaatactagggtcaccaagactcatgaccaaccagttgaggaggaggatggttaccagggggaggaccctgagtcaccattcacacagagtgatgaggggtcttctgaaactcccaacagcctggcttcagaggaaggcaatagcagctcagagacaggtgaactgcctgtgcaaggggactcccagagtcaaggggaccaacatggagagtctgtgcaaggaggtcacaataataacccagatacccagaggcagggaacacctggtgagaaaaacagagctctggaggcagtggtaccagcagtcagaggagaggatgtacagctcacagaggaccaggaacagcctgccagaggagaacacaagaatcaaggcccagggaccaaaggcccaggtgcagctgtggagcccaatggacacccagaagcacaggaatccacagcaggagatgaaaatagaaagtccctggaaatagagatcacaggtgccctggatgaagacttcactgaccagctttccctaatgcagctccctggaaagggagatagcagaaatgaattaaaggtccaaggcccaagtagcaaagaagagaaaggaagagcaacagaggcccagaatactctgttagaaagtctagatgaggacaattcagcctccctcaagatacaacttgaaacaaaggaacctgtaacatcagaggaggaagatgaaagtccccaagagctggcaggagaaggtggtgaccaaaaaagtccagccaagaaagagcacaattcttcagtcccctggtcaagtcttgaaaagcagatgcagagagaccaagagccctgttctgtggagaggggtgcagtctattccagtccactataccagtacctacaggagaagatactgcagcaaacaaatgtaacccaagaggagcatcaaaagcaagttcagatagcccaggcatcaggcccagagctttgcagtgtatccctcaccagtgagatctcagattgttctgtctttttcaactacagccaagcatcacaaccatataccaggggacttccacttgatgagagtcctgctggtgcacaggaaacaccagctccccaggccttggaagataagcaaggtcaccctcagagagagaggctggtactacaaagggaggcaagcaccacaaagcaatgaatcattatcatctcaacatgcccccaatttctctcccaatcaccctcaatactcacgtgtacacattcagatgcagattaacaatcttttaaattctcttcctaaatttctacaaaaacaaataataaaatattcagcagtgggggacaccactaaagaaacatctgagcaaacaaatacagtcagtaaaactcctaccaaacaatgctacttccaaatgccaaaatgggctttgtcatgagacagtttatctcaatgtacctgtcattaaaaatggaaaaattccttccatatctttagcaggtgccagtttttccaactgattcattgaatttaaaatagagcagtaggaaattataagactctgcaataatatctcataatcataaaatattaattcatatatatagattactctgcttcatgacatttcctagaagtatttcaagttcatcctaaaattttatccttcaaaataattttagacaatgccataacttaattatgattttctagcacttgattaaagtaaatttatgactctgctcatgttcaggtgcagctgaatctatcgccatggattcattctttcaattactcatccaacaaatttttattaaatcccactccttacacaaacttttcatagcttttggctcaaataaacaatcaagaataattatgagagaaaacacaaatctaaagtatgtttgattttataagaagctcttgtaaccaaccatccagtgagtctactaagtgtttacctatatggtttgatgagggtattaaattaaaattgataattaaacaacctgatgat

SEQ ID NO: 194591 - DNA, 3151 bp, Homo sapiens
  Payload ID: 18453
  Gene Name: trichoplein, keratin filament binding
  Uniprot ID: Q9BT92
  ENST ID: ENST00000312777
  CDS Start-End: 215-1711
gggcgcgagctcagggcgcctccggggtcctcactgcgctccccacgcgctgtgaccccatttgttgcacgtgcatgttcaggtcgagagagggatgcgacgtgttcggggagcagcccaccttgtgggtggccaatccgggacgggaatcttaaacttttaactcttggtgcaaagactgatccactggcggctttacgggagcgggaaaaaaatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcg

SEQ ID NO: 194592 - DNA, 3090 bp, Homo sapiens
  Payload ID: 18453
  Gene Name: trichoplein, keratin filament binding
  Uniprot ID: Q9BT92
  ENST ID: ENST00000405876
  CDS Start-End: 148-1644
gggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacagtaagtgcccggggcactgtcagatggctcagcagtgcctgctcaggttcatcattgaaacatcccagtgtttggccagacattaaggtgtcgtgagagtccctttcatgcctttcttacccaagcaagggtctttgatgggcacgtgtttacagcgctgctgcatagtcttgtaatatattaacagtcacatcaactgaaggtcaatactaagagccacaggttgtacctgtgatggggcgtgtggtttcctgttgtctcacctttaattgtcaacctccagtgttgactctagaaatatgaggaaagcttttcagtttttaaaattgccatttaaatttagtctattaaaaacaaacctagaggtcttggtgcagttgatttcagagtttattaatttagtggtcccaaaagtattacatcttttatattctggaagaaaagaactgtgaacaaattagaaccccggaacactctgacgtccatggacgcattccagaaaagtggcaagagatgagtctttcctcctccaggaagcattttggtagaatttccatagagcattgtctgtgagtgactgatcccaacatgtatgttactaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatattattttatgacttgtatttttactatacccttcctctgaggtttagttttcatcacattatgttcaagattccatatctccgtaaattacagctaattacagggcattgttccatggttattaaaaatcagagtttattaaaaatcctgagtcttaagggctgtcttacctttcacttccactgtcctgtagaaacagatcaagctgcaaaccacgtccttcatctgttgttcattttcttgcaactctttgactctgatcccctgagcagcacgttcatcacgcatgctctctgttgcgttccccatttcagatgtccagtaatggtgaaataaaatcctgcttcgacagca

SEQ ID NO: 194593 - DNA, 2077 bp, Homo sapiens
  Payload ID: 18453
  Gene Name: trichoplein, keratin filament binding
  Uniprot ID: Q9BT92
  ENST ID: ENST00000544838
  CDS Start-End: 154-1650
gtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaacagcaagaagccaccgcagagcaagagaacaaacggtatgaaaatgaatatgaaagggcccgaagggaggcgctagaaaggatgaaagctgaagaggagaggaggcagctggaggacaagctccaggccgaggcactgctgcaacagatggaggagctgaagctgaaggaggtggaggcgaccaaactaaagaaggagcaggagaatctgttgaagcagcggtgggagctagagaggctggaggaagagcgaaagcagatggaagccttccggcagaaggcagagctggggcgtttcttgagacatcagtataacgctcaactcagcagacgcacacagcagatccaagaggagctggaggcagacaggcggatcctgcaggccctcctcgagaaggaggacgagagccagcgcctccacctggccaggcgggagcaggtcatggccgatgtggcctggatgaagcaggccattgaggagcagctgcagctggagcgggcgcgggaggcagagctgcagatgctgctgagggaggaggccaaggagatgtgggaaaagagagaggcagagtgggcccgagagcgcagcgcacgggacagactgatgagcgaggttctgacagggagacaacagcaaatacaagagaagattgagcagaaccgacgggcacaagaggaatccctgaaacacagggagcaacttattcgaaatcttgaggaggtgagagagttggctcgtcgcgagaaagaggagagtgaaaagctgaaatcggccaggaagcaggagctggaagcccaggttgcagagcgccggctgcaggcatgggaagcagaccagcaggaggaggaggaagaggaggaggcccggcgggtcgagcagctctcagatgccctgctgcagcaggaggcggagactatggctgagcagggctaccggcctaagccttacggacatccaaaaattgcttggaactgacttcatgggtaccataagtacagagaacaagggatgctgaggcttctgatcccagccgccaggcagttttacagggctctgttaacaaaatctgaagagttctgcgtctgaatttgaaattggactttataaagcctagaaaacagaggaggcggtgccctgcccttgtcagttgttgttctctttggtggtgatggtaaccagctgcttggcagccttggcgatgtcgtacgcacactggatgacctgctgcgtgaccagctgaacgtctgtggtggtttccaaatctgtgtcttcgtctgatgccacgctgtcatagtcgggctgatcgttgtcttgactctcaacgctgtgctggttattgatggttttcagtatgagctccacattgtctatcaataaaagcaaacaactttacttcaggctt

SEQ ID NO: 194594 - DNA, 973 bp, Homo sapiens
  Payload ID: 18453
  Gene Name: trichoplein, keratin filament binding
  ENST ID: ENST00000536408
  CDS Start-End: 452-973
gggatgcgacgtgttcggggagcagcccaccttgtgggtggccaatccgggacgggaatcttaaacttttaactcttggtgcaaagactgatccactggcggctttacgggagcgggaaaaaagtatgtgaagcttgccacggtctcgagaccgaggtcacacgttagcagcctgccggctacatttggaccatagacgcagagtgtttgcccccaaaactggaggacctccagaatgagattcttggcgtgcaccaggccttttcgctcattcagccggcgttcctacccaggcactgcatcgaccctacacttgaggacagcttttgggtcaggggaattggtgcctggagtgagactgctctctgctttcaaggctccagctgtatccctacattgctcaggcaattcctctctctaggtctcagcttcttcatctgcaagatgaaagatggcgctcccgacgctgccgtcctactggtgcagccagcagcgcctgaatcagcagctagcacgacagcgagagcaggaggcccggcttcggcagcagtgggagcagaacagccgttacttcaggatgtctgacatctgcagctccaaacaggcagaatggagctctaaaacctcctaccagcggagcatgcatgcctatcagcgggagaagatgaaggaggagaagaggaggagtctggaggcccgacgggaaaagctcaggcagctcatgcaggaggagcaggacctgctggccagagaactggaggagctgaggctgagcatgaacttgcaggaaagaagaatccgggagcagcacgggaagctgaaatcagccaaagaagagcagaggaaactgattgctgaacaacttttgtacgaacactggaaaaagaacaacccgaaacttcgagagatggagctggaccttcaccagaagcatgtcgtaaactcttgggaaatgcagaaagaagaaaaaaaa

SEQ ID NO: 194595 - DNA, 5480 bp, Homo sapiens
  Payload ID: 18454
  Gene Name: trichorhinophalangeal syndrome I
  Uniprot ID: Q9UHF7
  ENST ID: ENST00000220888
  CDS Start-End: 161-4006
ggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaa

SEQ ID NO: 194596 - DNA, 581 bp, Homo sapiens
  Payload ID: 18454
  Gene Name: trichorhinophalangeal syndrome I
  ENST ID: ENST00000395713
  CDS Start-End: 231-581
accattctgcactacttctgctccaagaatccaccactatcttggttcctgagagattaaggatgatgttttctgttgtataatgaacagcagtattatttgaacaaagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgag

SEQ ID NO: 194597 - DNA, 9990 bp, Homo sapiens
  Payload ID: 18454
  Gene Name: trichorhinophalangeal syndrome I
  Uniprot ID: Q9UHF7
  ENST ID: ENST00000395715
  CDS Start-End: 579-4463
aatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtaacgactagcattggaaaatacatatcactattcttggaatatttatggtcagtctactttttagtagaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatataaactgcagcatatcactttttctttttgtgcctcaggttcctcagctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacaca

SEQ ID NO: 194598 - DNA, 569 bp, Homo sapiens
  Payload ID: 18454
  Gene Name: trichorhinophalangeal syndrome I
  ENST ID: ENST00000451156
  CDS Start-End: 543-569
acatgcattttctttcttcctttttgagcgtgtgatttctttctttctttcttctcttctgctccctttttcccccttcctctcctccttttggtgggtctgaggcatctgagctttggaaaccagcgacttcaaactgcagtagcccctggagtcagcagggtcaagttcagccgccggggaggaggaaaaacaaatccccatttgccaaaaaaagaagtttcaggccggtgccccctccccctcgcagccccactccccctcgctgtctctttctggctgattttaattctctcctaccgggcgcagcggaggagctggaggtggttggacccgaggggccgccgccgccgccgccactgcaagttttctgggggctcgtgacaagcggggcgcagactaggcaccagcatgcagagtaatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtat

SEQ ID NO: 194599 - DNA, 581 bp, Homo sapiens
  Payload ID: 18454
  Gene Name: trichorhinophalangeal syndrome I
  ENST ID: ENST00000422939
  CDS Start-End: 397-581
agtaagagaaaaatacactggagttttcatggcgtttctaggaaacaagaacaaaacaaggttcttaggaaagattttgaaaccccattcaaagaggacttctaaagaaaatgtcactacaaagagtaatttctctagcacagaaatatcttcaacgttttgtgatttcctgacgatgaaacttcaagtggcttcctgctttctccaagtggtccagcctcatcaactgggattcaagattctgtcttattaaccttggcaaccacgtcttccatatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagag

SEQ ID NO: 194600 - DNA, 813 bp, Homo sapiens
  Payload ID: 18454
  Gene Name: trichorhinophalangeal syndrome I
  ENST ID: ENST00000518018
  CDS Start-End: 1-813
caagagcactgtcacccctctgattctgcctaagaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccacctt

SEQ ID NO: 194601 - DNA, 4083 bp, Homo sapiens
  Payload ID: 18454
  Gene Name: trichorhinophalangeal syndrome I
  Uniprot ID: Q9UHF7
  ENST ID: ENST00000520276
  CDS Start-End: 125-3982
aattctctcctaccgggcgcagcggaggagctggaggtggttggacccgaggggccgccgccgccgccgccactgcaagttttctgggggctcgtgacaagcggggcgcagactaggcaccagcatgcagagtaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatag

SEQ ID NO: 194602 - DNA, 3329 bp, Homo sapiens
  Payload ID: 18454
  Gene Name: trichorhinophalangeal syndrome I
  ENST ID: ENST00000519076
  CDS Start-End: 13-3120
atctttgcagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcactgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatgatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaa

SEQ ID NO: 194603 - DNA, 3116 bp, Homo sapiens
  Payload ID: 18454
  Gene Name: trichorhinophalangeal syndrome I
  ENST ID: ENST00000519674
  CDS Start-End: 362-3070
agcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacgggtttttgaatctgcttggatgactcccgaagagcagtttagtctttgagaaaaccagatctccattgcttccatgaagatcttattaatattta

SEQ ID NO: 194604 - DNA, 584 bp, Homo sapiens
  Payload ID: 18454
  Gene Name: trichorhinophalangeal syndrome I
  ENST ID: ENST00000519815
  CDS Start-End: 261-584
gagaagggaaagtaacaacagaaaaggtaaaaggactttgagagttctttaaattgtttctgttagcatctctgagtgtctggggaacgtcggtttggcggccacgcactgccccccacctgccccccactaccccaagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggagga

SEQ ID NO: 194605 - DNA, 2171 bp, Homo sapiens
  Payload ID: 18454
  Gene Name: trichorhinophalangeal syndrome I
  ENST ID: ENST00000517323
  CDS Start-End: 99-2171
ggagctggaggtggttggacccgaggggccgccgccgccgccgccactgcaagttttctgggggctcgtgacaagcggggcgcagactaggcaccagcatgcagagtaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatgatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacgg

SEQ ID NO: 194606 - DNA, 1690 bp, Homo sapiens
  Payload ID: 18455
  Gene Name: triggering receptor expressed on myeloid cells 1
  Uniprot ID: Q9NP99
  ENST ID: ENST00000244709
  CDS Start-End: 65-769
attgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctgg

SEQ ID NO: 194607 - DNA, 1043 bp, Homo sapiens
  Payload ID: 18455
  Gene Name: triggering receptor expressed on myeloid cells 1
  Uniprot ID: Q9NP99
  ENST ID: ENST00000334475
  CDS Start-End: 28-480
agcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaaggggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccag

SEQ ID NO: 194608 - DNA, 2048 bp, Homo sapiens
  Payload ID: 18455
  Gene Name: triggering receptor expressed on myeloid cells 1
  Uniprot ID: Q9NP99
  ENST ID: ENST00000591620
  CDS Start-End: 28-705
agcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcaggtatagtttccaggtccctgggcccctggtttggacactgagccctttgtttcccagtctgtgtgctgagaggatgtgaaagtgagggaaaggggagggtggggcaggagaagacttgagtcacattagtctgggtagaaatgtccaggggaagaaggaagtggtgatggagaataggggaggctctcagccaggctgtccttctccccagttcaccttctttgtttccttgcaacctgagtattaaagagagggaaatggcatcttccccaagttccagtggagctcatccaaccccaggggcctgatgggcagtgggaaagcactctgagtgaggggccctggatctagtgttggcctgactaactgaatgtgactttgggtgagtcaggaaccctctctggctttagcttctttgacaattcagtaggcatggtagaaacccaaagctggaagacattgtccacctaataactctcagcaggagctggagctggggctaaatgcagtattggtttttgccttattgttttttaaataacattgttgcatgtgcccaattatagataaatagaatcagaatttttgcagatgaggtccctctcagtatttttaataagatgtttaggagatttctaatgtgtaggcaaacttaagaaccactaacttagcaatttcacacctctttacagttattaaatgttgatttatattagaatgtgtttatcattaaatactgaattatcaggatggaaatacttttccacatcaccactagtctaacatgtcttttttctcatattctcttctagtctttattcatgtttatacatattttaatatggcagtaagtctaattatacatgtttttattcttttccttgctgaaattattctttgatgctgctacctaaatttcataaatataatttcaatgagtgcatatttttctatcaattgggaaagccataacttacataaccattggcctgttcttagacattgatatagtgttgataactctgagataaacatattcttgcagatatatttttcttcttttaaataattaactcgaaatttccatgagataatttaaacactgatatcattttgtatacaaatagcatctaccaatggtcttccaaaagattggaaacaatttgcagtgtgatccattaagcataaataaagcagtgtcatggcaggcttacagacacggatttagtcttttaaatcattaaatagtgtgagttaaatcacattcctgctaaaacaaatgtgaactggtgcctgctctaatttctctatgagtgtagactccacctccatatgggtagtggcagtgcctttttccccattatgttgtttggggaacaaagtgctcattaaacttctgtggaataaatcaaacgaatgatc

SEQ ID NO: 194609 - DNA, 772 bp, Homo sapiens
  Payload ID: 18455
  Gene Name: triggering receptor expressed on myeloid cells 1
  ENST ID: ENST00000589614
  CDS Start-End: 11-763
cacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggaaaagagcatgacatttggcatcagaaggctggatgtggaatcccatcctctcccaccactgcacactgggcactttcggataagtcagttcttctcccaggctggaactcaatccttgcattcatgttataaaggaaaacctacgccctgaaagatggca

SEQ ID NO: 194610 - DNA, 860 bp, Homo sapiens
  Payload ID: 18456
  Gene Name: triggering receptor expressed on myeloid cells 2
  Uniprot ID: Q9NZC2
  ENST ID: ENST00000338469
  CDS Start-End: 105-764
gggcagcgcctgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggat

SEQ ID NO: 194611 - DNA, 1044 bp, Homo sapiens
  Payload ID: 18456
  Gene Name: triggering receptor expressed on myeloid cells 2
  Uniprot ID: Q9NZC2
  ENST ID: ENST00000373113
  CDS Start-End: 95-787
tgacatgcctgatcctctcttttctgcagttcaagggaaagacgagatcttgcacaaggcactctgcttctgcccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggat

SEQ ID NO: 194612 - DNA, 1012 bp, Homo sapiens
  Payload ID: 18456
  Gene Name: triggering receptor expressed on myeloid cells 2
  Uniprot ID: Q9NZC2
  ENST ID: ENST00000373122
  CDS Start-End: 22-690
ccttggctggggaagggtggcatggagcctctccggctgctcatcttactctttgtcacagagctgtccggagcccacaacaccacagtgttccagggcgtggcgggccagtccctgcaggtgtcttgcccctatgactccatgaagcactgggggaggcgcaaggcctggtgccgccagctgggagagaagggcccatgccagcgtgtggtcagcacgcacaacttgtggctgctgtccttcctgaggaggtggaatgggagcacagccatcacagacgataccctgggtggcactctcaccattacgctgcggaatctacaaccccatgatgcgggtctctaccagtgccagagcctccatggcagtgaggctgacaccctcaggaaggtcctggtggaggtgctggcagaccccctggatcaccgggatgctggagatctctggttccccggggagtctgagagcttcgaggatgcccatgtggagcacagcatctccaggccatctcaaggctcccatctgccttcttgtctctccaaggagcctcttggaaggagaaatccccttcccacccacttccatccttctcctcctggcctgcatctttctcatcaagattctagcagccagcgccctctgggctgcagcctggcatggacagaagccagggacacatccacccagtgaactggactgtggccatgacccagggtatcagctccaaactctgccagggctgagagacacgtgaaggaagatgatgggaggaaaagcccaggagaagtcccaccagggaccagcccagcctgcatacttgccacttggccaccaggactccttgttctgctctggcaagagactactctgcctgaacactgcttctcctggaccctggaagcagggactggttgagggagtggggaggtggtaagaacacctgacaacttctgaatattggacattttaaacacttacaaataaatccaagactgtcatatttagctggata

SEQ ID NO: 194613 - DNA, 1194 bp, Homo sapiens
  Payload ID: 18457
  Gene Name: triggering receptor expressed on myeloid cells-like 1
  Uniprot ID: Q86YW5
  ENST ID: ENST00000373127
  CDS Start-End: 50-649
tgcatcagtgcccaggcaagcccaggagttgacatttctctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaagctgctcatcacactttaaactcatgaggaccatccctaggggttctgtgcatccatccagccagctcatgccctaggatccttaggatatctgagcaaccagggactttaagatctaatccaatgtcctaactttactagggaaagtgacgctcagacatgactgagatgtcttggggaagacctccctgcacccaactcccccactggttcttctaccattacacactgggctaaataaaccctaataatgatgtgcaaa

SEQ ID NO: 194614 - DNA, 647 bp, Homo sapiens
  Payload ID: 18457
  Gene Name: triggering receptor expressed on myeloid cells-like 1
  Uniprot ID: Q86YW5
  ENST ID: ENST00000437044
  CDS Start-End: 45-647
cagtgcccaggcaagcccaggagttgacatttctctgcccagccatgggcctcaccctgctcttgctgctgctcctgggactagaagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagggaacaggcttggtgtctgtggccgattcctgagcagcagagtttcaggcatgaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaa

SEQ ID NO: 194615 - DNA, 981 bp, Homo sapiens
  Payload ID: 18457
  Gene Name: triggering receptor expressed on myeloid cells-like 1
  Uniprot ID: Q86YW5
  ENST ID: ENST00000426005
  CDS Start-End: 45-980
cagtgcccaggcaagcccaggagttgacatttctctgcccagccatgggcctcaccctgctcttgctgctgctcctgggactagaaggtcagggcatagttggcagcctccctgaggtgctgcaggcacccgtgggaagctccattctggtgcagtgccactacaggctccaggatgtcaaagctcagaaggtgtggtgccggttcttgccggaggggtgccagcccctggtgtcctcagctgtggatcgcagagctccagcgggcaggcgtacgtttctcacagacctgggtgggggcctgctgcaggtggaaatggttaccctgcaggaagaggatgctggcgagtatggctgcatggtggatggggccagggggccccagattttgcacagagtctctctgaacatactgcccccagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagggaacaggcttggtgtctgtggccgattcctgagcagcagagtttcaggcatgaatccctcctcagtggtccaccacgtcagtgactctggaccggctgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaag

SEQ ID NO: 194616 - DNA, 3302 bp, Homo sapiens
  Payload ID: 18458
  Gene Name: triggering receptor expressed on myeloid cells-like 2
  Uniprot ID: Q5T2D2
  ENST ID: ENST00000483722
  CDS Start-End: 187-1152
ataggctcaatgaatccctgcggttggctgggggcagtgggtcccacactgcctcacttccctaaatgggcagcttcacttttagaaccccgggtccttccctggcaggcccaggtggcacatcctgtgtcgggtgggccctcaccttggatctccaggcctgacactgcccagctggatggaaccatggccccagccttcctgctgctgctgctgctgtggccacagggttgcgtctcaggcccctctgctgacagtgtatacacaaaagtgaggctccttgaaggggagactctgtctgtgcagtgctcctataagggctacaaaaaccgcgtggagggcaaggtttggtgcaaaatcaggaagaagaagtgtgagcctggctttgcccgagtctgggtgaaagggccccgctacttgctgcaggacgatgcccaggccaaggtggtcaacatcaccatggtggccctcaagctccaggactcaggccgatactggtgcatgcgcaacacctctgggatcctgtaccccttgatgggcttccagctggatgtgtctccagctccccaaactgagaggaacattcctttcacacatctggacaacatcctcaagagtggaactgtcacaactggccaagcccctacctcaggccctgatgccccttttaccactggtgtgatggtgttcaccccaggactcatcaccttgcctaggctcttagcctccaccagacctgcctccaagacaggctacagcttcactgctaccagcaccaccagccagggacccaggaggaccatggggtcccagacagtgaccgcgtctcccagcaatgccagggactcctctgctggcccagaatccatctccactaagtctggggacctcagcaccagatcgcccaccacagggctctgcctcaccagcagatctctcctcaacagactaccctccatgccctccatcaggcaccaggatgtttactccactgtgcttggggtggtgctgaccctcctggtgctgatgctgatcatggtctatgggttttggaagaagagacacatggcaagctacagcatgtgcagcgatccttctacacgtgacccacctggaagaccagagccctatgtggaagtctacttgatctgaggccacttaagcatggggtggggagcttctcccagagtggccccagggggttagaggaggggtgaagattggggccagtatcgatcttatgaagctggaggacttgtgcagtgctggactcacccaggacttcccaaacccagaggctgccatcctaagcagccccacagcccagtgttctccttgggggcaggaacctggggaggggcccagagcaaagggcatcagggagaaagtcccgaggaaatgtgaccagtggtttctgctcggagctgcagaccccagggctcttggtggaggcaggggaaccctgagagtgctgtttacagagaacctcagctcccgtctgcctcagaaaccctattgggctgagctgccctccccaccagggccactgtgtcctctgcttccctccgttctgcttcagcttcccctaaggttagggaagaaagaatcgggctcacgaatgccagaggcagtgatgtcccatcctggaggagaggaaacagtgactaaaagctggggacccacagaggggttggcagcttctcttgtcgggacaggtgtcctttgctgggcctctggatggccctgccctgactggggctgctcctccctcctgtcctgggaccgcgcagagcccacgctctcactgctgcctcctgctggccgctgcctccttagaaagctgtgaccaggcagctaagagcctctgggctgcagggtcagcctctcccaagactgaagtgcagaggctggacttggggctctctcccccagcttctacacctgggctccaagtctgagttcccacaggggacccagcagcctccaggaagtccataccctggggtggctgagaccttggctctgtatggaggctgctcaccccacagacactggtggggagaccatggctcagaggaagggtggagcaaccctcctcctacccctcaggatagagagagaagacacacttgggacacagtgaagacagtaacttggaactgaccacggcctggaggactggcccaggcagggggacagggaaaatggagcccaagtagcctctggccagggacccaatgtcccgaggaatctgcctcccacccactgactcagggctcagactcagcctctattgtccagagcactggcttggcgtccagcaatgaaggctggagaatgcagcctggattcccctacacacacacacacacacacacacacacacacacacacacacacacacacacaggtgtctactgacctggagtgactggaatagcacctggggataaatgtgacaactgtgcattgaaccctgggtcagggacgttccaatggccaagagagtgacacagccaggaccctggtggacagccagaggggccacttcaggatggatgtggggagagtggaagaggcagggagtaatcctgggggacagcagggaggaggcacttcttccctatgtccaggagagggcaatagagggaagactgaggctgaagaattgacggctctggacccaggacagacagacagacagacagacagacagacagacagacacgcacacacacccatctctgtctagcaagcagcctcctaagatagctgttctccctatcatgacggtgtagccaccatcctgttgtatactaggagagaacttaacccacctgggggaaaatagctccccaagagctggcaccagtaccactgatggccctgcttcctctgagtgagatgcccaggaggaggagccctagggaagaagtcagggacagggaccaggataccactctgtcactgtgtgaccctcagcaagtcactaacccttggcctcatttttcctgtcttgtgaaagaggacaataattcctacttctcaagattgttttcaagataaaataacattagcattgtacaatgatgcaaatgcctcattaccattattccttaagttgttttccagctctaatgttgtttccaacattacatttaagaccttaggattctgtttcttgcttttgtcatatctcttcccaagtgtcatcactatatggatgttgagggcccccgatgacagtccctttggtaaggtcctcttttgaggaggggagggtacagggtggactcatctca

SEQ ID NO: 194617 - DNA, 2070 bp, Homo sapiens
  Payload ID: 18459
  Gene Name: triggering receptor expressed on myeloid cells-like 4
  Uniprot ID: Q6UXN2
  ENST ID: ENST00000341495
  CDS Start-End: 105-707
gacactgggaacctggggcagaatcagacccagcgtctgactcctcctgagagggctcccttttttctcctctcctccgctgtcagaaacagatctgggctggaatggcctggggtggggtccacacctgctgcttccacctgtgctgctgctgctcctggcctcagggtgctgtgcctgaagaacttcacaaacacccaggacagaccctcctcctgcaatgccagtactcacccaagagagggccctatcagcccaaatcctggtgtcagcagacatctccaagtcggtgtaccttacttgtcaccagctccaagccctggacagcagttcagaagtctcattacacaatctgggacaagcccaatgctggcttcttcaacatcaccatgattcagctgacacagaatgactcgggattctactggtgtggaatctacaacgcttccgaaaacatcatcactgttcttagaaatatcagcctggtggtgtctccagccccaaccacgtctcctatgtggactcttccctggctcccaacaagcacagttctgatcacttctccagaggggacctctggccatccctccatcaatggctctgagaccaggaaatcaagagcccctgcctgccttggctcaggtggccccagattcctggtcttggtgctatgtggactcctcctggccaagggcctgatgttgtgagtcctgttagtgctcctgatctgcaggtgccacaggacagcagtgacgaggtttctgattgtcccagcacagccttgtcccaggacccttgggtgcatgagccacaacatggatcctggatgaatcccagttcttcccctgcccagctattgggagctggcctaagtattgctccccacctccttgtgaggaaaggctagcgctaagcctattggagagaactttcagcccctgaactccccggtggtgacccctcacccctgcactgagcccccttagatctactgcccctgccctgactttcgccattgggaagacctggggtgggggtttctgcatccgggtcaatgcccagctcagcatcttcagctgtgcccaggctcctctccagcactctgtcgttctctgagccccacctcagcaggtctccaggatccctcacatttcccctgtttgttgcctgtggtctgccctagagtcctatgaatttcctcttgtgcttaattaaattcaacctctgaactgaaatgtgtcaggggcagctgagcaagacagcagttgtatcccctcaccttcctcccgtcccaccccagatatcctaaatgagagagaaatgacttaaaaataaatgataaaattgaaactaagaaaggctgtaatcagcagactggaagctgaggaagatctagaagtaaaagaaaaaattagatgcgttaaaatgacatgagcaggcgactcagtggcccaaaacaggacccagaacattcatccgtaaatggaatctgataatctggggcccaaattctgtttacttaacatgtgagaagattcacagcctaaaagagaaaatcaagttgaactaacaataaatgatggtgggtgaaagataaatgttttagggaacagaagaggagcacatatttatgaagcaagaataggtacagtcattttccaactaacatctagtgagactgggattcaccactcagaatgggggtccaccatgagcaacagatttgaggtaccagtgcatagcagctgaatgccagccctgtaaaagaccaccataaagagagctccatgttcttttgctcttttggggatgggacatcaaacaaaagtctcttcgtgtatatctcagctcctgccacatgatcatcacctatctgtgagaggcatcgcttttgctttgtttatttatttttttaatcctcattccctatgtccacttgccttcctctccgaggcaactactctaatgcatttggtatgtaactttaaatttgaatgtattcttgtaaaacatccagtatttttttttctgtgactatgttttcacttacataaaagaaattgtgataga

SEQ ID NO: 194618 - DNA, 768 bp, Homo sapiens
  Payload ID: 18459
  Gene Name: triggering receptor expressed on myeloid cells-like 4
  Uniprot ID: Q6UXN2
  ENST ID: ENST00000448827
  CDS Start-End: 90-692
gggcagaatcagacccagcgtctgactcctcctgagagggctcccttttttctcctctcctccgctgtcagaaacagatctgggctggaatggcctggggtggggtccacacctgctgcttccacctgtgctgctgctgctcctggcctcagggtgctgtgcctgaagaacttcacaaacacccaggacagaccctcctcctgcaatgccagtactcacccaagagagggccctatcagcccaaatcctggtgtcagcagacatctccaagtcggtgtaccttacttgtcaccagctccaagccctggacagcagttcagaagtctcattacacaatctgggacaagcccaatgctggcttcttcaacatcaccatgattcagctgacacagaatgactcgggattctactggtgtggaatctacaacgcttccgaaaacatcatcactgttcttagaaatatcagcctggtggtgtctccagccccaaccacgtctcctatgtggactcttccctggctcccaacaagcacagttctgatcacttctccagaggggacctctggccatccctccatcaatggctctgagaccaggaaatcaagagcccctgcctgccttggctcaggtggccccagattcctggtcttggtgctatgtggactcctcctggccaagggcctgatgttgtgagtcctgttagtgctcctgatctgcaggtgccacagcagtgacgaggtttctgattgtcccagcacagccttgtccc

SEQ ID NO: 194619 - DNA, 2304 bp, Homo sapiens
  Payload ID: 18459
  Gene Name: triggering receptor expressed on myeloid cells-like 4
  ENST ID: ENST00000461240
  CDS Start-End: 1-215
atgactcgggattctactggtgtggaatctacaacgcttccgaaaacatcatcactgttcttagaaatatcagcctggtggtgtctccagccccaaccacgtctcctatgtggactcttccctggctcccaacaagcacagttctgatcacttctccagaggggacctctggccatccctccatcaatggctctgagaccaggaatggcagctaagagcaaaatgaagaacaagagaaaatacattcatggtcattgaaaaataacattctagactagcagtccccaacctttatggcaccagagactggcttcgcagaagacaatttttccatggacttggaggaaatcaagagcccctgcctgccttggctcaggtggccccagattcctggtcttggtgctatgtggactcctcctggccaagggcctgatgttgtgagtcctgttagtgctcctgatctgcaggtgccacaggacagcagtgacgaggtttctgattgtcccagcacagccttgtcccaggacccttgggtgcatgagccacaacatggatcctggatgaatcccagttcttcccctgcccagctattgggagctggcctaagtattgctccccacctccttgtgaggaaaggctagcgctaagcctattggagagaactttcagcccctgaactccccggtggtgacccctcacccctgcactgagcccccttagatctactgcccctgccctgactttcgccattgggaagacctggggtgggggtttctgcatccgggtcaatgcccagctcagcatcttcagctgtgcccaggctcctctccagcactctgtcgttctctgagccccacctcagcaggtctccaggatccctcacatttcccctgtttgttgcctgtggtctgccctagagtcctatgaatttcctcttgtgcttaattaaattcaacctctgaactgaaatgtgtcaggggcagctgagcaagacagcagttgtatcccctcaccttcctcccgtcccaccccagatatcctaaatgagagagaaatgacttaaaaataaatgataaaattgaaactaagaaaggctgtaatcagcagactggaagctgaggaagatctagaagtaaaagaaaaaattagatgcgttaaaatgacatgagcaggcgactcagtggcccaaaacaggacccagaacattcatccgtaaatggaatctgataatctggggcccaaattctgtttacttaacatgtgagaagattcacagcctaaaagagaaaatcaagttgaactaacaataaatgatggtgggtgaaagataaatgttttagggaacagaagaggagcacatatttatgaagcaagaataggtacagtcattttccaactaacatctagtgagactgggattcaccactcagaatgggggtccaccatgagcaacagatttgaggtaccagtgcatagcagctgaatgccagccctgtaaaagaccaccataaagagagctccatgttcttttgctcttttggggatgggacatcaaacaaaagtctcttcgtgtatatctcagctcctgccacatgatcatcacctatctgtgagaggcatcgcttttgctttgtttatttatttttttaatcctcattccctatgtccacttgccttcctctccgaggcaactactctaatgcatttggtatgtaactttaaatttgaatgtattcttgtaaaacatccagtatttttttttctgtgactatgttttcacttacataaaagaaattgtgatagacctttttcatatgcttgtcttactccttgctgggcacatatacacagcccacttcttttcagtgcttattccattgcgtacatatcccacagtgcatcattccgaacccagggtgcatgtgcttttttgccttcacttttctatatcataaatgatgctgtgatgaataccctccttcacgttctcttgtggaatcatgtgagacttcctttaggacttatacacaggtggcatcagctgggttgtgggatctcagacatctaattaatactgccagcttgtgttgcctgaaccaagaatctagacactagcgattatgtgttttctctgagtctatgtgaagtacacagcacaacctatggaatggtattgccaattaaaaaaaaaatggaaggcaagaataaacgtagctgagtgatgctacatggggctagatatatgattatctctacttttgtgtatgcttggaaattttcataattaaaatggtacctaaaatt

SEQ ID NO: 194620 - DNA, 1698 bp, Homo sapiens
  Payload ID: 18460
  Gene Name: TRIM39-RPP21 readthrough
  ENST ID: ENST00000623385
  CDS Start-End: 143-1654
agaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaaatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacatt

SEQ ID NO: 194621 - DNA, 3391 bp, Homo sapiens
  Payload ID: 18461
  Gene Name: TRIM6-TRIM34 readthrough
  ENST ID: ENST00000354852
  CDS Start-End: 174-2702
ctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaaaacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaa

SEQ ID NO: 194622 - DNA, 3782 bp, Homo sapiens
  Payload ID: 18462
  Gene Name: trimethylguanosine synthase 1
  Uniprot ID: Q96RS0
  ENST ID: ENST00000260129
  CDS Start-End: 478-3039
tgggagaccggacgcgcgcggcctccgccgctcccagtcccgccagacccgatgccgggctggagaagcgcgggggccgacgcacctcggataggcgggggcaggggcaggggcagctctcctttaccctagagcggcgacagaagctcttcgggggatcagtggccaagggggcggacagatttgcacggcggattcctccgaagcaacccgtgtgaaagaagccaagcggcggctgcagcccgggccgcgatgggggtgacaccgcccgtggtcccgccccttcccgtggcccctcggagccacttccggcggcagcgtccgggctagttcccggcgcgagcggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcattgaggagcgggaggattgtaagatactgtgcctttgctccagggcatttgtggaggatcgaaaattgtacaatttgggattaaaaggctattacatcagagacagtggcaacaattcaggagaccaggcgacagaagaagaggaaggtggttattcctgtggtactgcagaatcacatgacagcaaaggcataggcctggatgaaagtgaacttgattctgaggctgaactcatgagaagtatgggattgccacttcaatttggtaggataactgcacataaggattttgaggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggctttgaaattttcagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaa

SEQ ID NO: 194623 - DNA, 3159 bp, Homo sapiens
  Payload ID: 18462
  Gene Name: trimethylguanosine synthase 1
  ENST ID: ENST00000523948
  CDS Start-End: 150-311
agttcccggcgcgagcggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcattgaggagcgggaggattgtaagatactgtgcctttgctccagggcatttgtggagagaccaggcgacagaagaagaggaaggtggttattcctgtggtactgcagaatcacatgacagcaaaggcataggcctggatgaaagtgaacttgattctgaggctgaactcatgagaagtatgggattgccacttcaatttggtaggataactgcacataaggattttgaggtatctatgaatactagaaataaagttaaaataaaaaagaaaaaacatcaaaagaaatacttagatgaaattgtgcaagaatcttggagaaaagaatatgaagaagacgacattttggcttcagatgatccatcttcaattgaacagtatgagaacaccagaacatatgaacttcaaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgaggattcacagaagtcttcaggagcaaacacaagcaaagacagaccacatgccagtggtactgatggagatgaaagtgaggaagacccacctgagcataagccaagcaaactgaagaggagccatgaactggacattgatgaaaacccagcttcagactttgatgacagtggttcccttctaggattcaagtatggctcaggacaaaaatatggtggaatcccaaatttcagtcatcggcaggtcaggtatttagagaagaatgtgaagcttaagtctaagtacctagacatgcgcagacaaataaagatgaaaaacaaacacatcttctttaccaaagagtcagaaaaaccatttttcaagaaaagcaaaattctgagtaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaagctgaagtgaaaaagaagaagaacaagaagaagaacaaaaaggtgaatggtctgcctcctgaaatagctgctgttcctgagctggcaaaatactgggcccagaggtacaggctcttctcccgttttgatgatgggattaagttggacagagagggctggttttcagttacacccgagaagattgctgaacacattgctggccgtgttagtcagtccttcaagtgtgacgttgtagtagacgcattctgtggagttggaggaaataccattcagtttgccttaacaggaatgagagactttctaagaagatcactaataatattgtttattttcttccaagaaatgctgatattgaccaggtggcatccttagctgggcctggagggcaagtggaaatagaacagaacttccttaacaacaaattgaagacaatcactgcatattttggtgacctaattcgaagaccagcctctgaaacctaactatgcagcagtgcgaggacaaaagatcatggagtggtcaaaatattcagatgagacatttggcatgtcttcctttattcactgatattttctacccatggtcttatatcaccgtatgaaatggaaacttacaggacttaaatatcagtgaaatattttgagatctttgaataattcctttagaggaattatacaaaattaatatatatgagtcctttgtaatttatttttttttgagacaggatctcacttttaccgcccaggctggagtgcagtgccatgatcacagctcactgcaggttcagccttctgagttcaagcaatccttctgtctcagtctcctcagtagctggggctttaggtgggcactgccacaccgtactaatttttgtattttttgtagagacgaggtcccaccatgttgcccaggctggtgtcaaactcctgggctcagtcagtccccccatctcaccctccccaagtgctggaattacaggcgtgagctactgtgcccagccttacggacatccttttgaattatctttttcactcatagaatatgaatacatttatttagactttttctagaactttcctgttttcatgtctttgcttcatctggaattggcttaacacccttttataaagtttgtgtttgtaaaatttccattgtgacatcaatacgcaatatattttgtaatataggagtttctatttttttattaaaatggcaatgaaagcaaga

SEQ ID NO: 194624 - DNA, 2832 bp, Homo sapiens
  Payload ID: 18463
  Gene Name: trimethyllysine hydroxylase, epsilon
  Uniprot ID: Q9NVH6
  ENST ID: ENST00000334398
  CDS Start-End: 147-1412
ccgagcgggctgggggaggggagcgtggggccgacagttttgggggtgaaaaggcaaaaggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcaggtacaacaactatgaccgggctgtcatcaataccgttccttatgatgtcgtccatcgctggtatacagcacaccggactctaacgatagagttgaggagacctgagaatgagttttgggtcaaactaaagcctggcagggtcctatttatagacaactggcgtgtcctacatggcagggaatgcttcactggctaccgccaactgtgtggctgctatttaacaagagatgatgtattaaacactgctcgcctcttggggcttcaggcttaaaattgacagcatctggattatgaatacacctggcaccctggctaccagaatttcatatgggcagaataatattgtgtcaaactctacttcagattgtctccttatcccatcccacaaaacagaatctgtccgtttctctagtaagggagacttgttggagaggcgggactctgagttatctaatgtcagacatctagtggggcagctctcttcctcatgttataacatggatccacttgtttgatttaaaccttttaatataattttggtcagtctccttcagaaatataatctccatattgataggaaagcaataattgccatgaggtaacgatttttttcccaagtagatcagttagaaagaaatgcattctagaaataacaaaaatcctgataaagcaacaatttgcaaaatgtttggtcttaggacaccttaacactcttaaaagttattgaaggccccaaggagttcttgggtgtgggttctatctattgatactaattattttaggtattaagactgagaaatatttaaagctcaagaagaacacagaagcacacatccctcagctatgagagagatgacataaccatatgtcatgtagcctctggaaaagtcctctgtatcctcatgagataacgagagggggaaaaaaagctactactgcctttgtaacttccacttagcctactacagggctatgcacatcttagtttccaaaagtctgcttaatttcaaaagaaaaatgcctaattgaatgtaactcatcttggtgttattatacaaaataatttttaatctgcagacccacgaaaagggtctcagggactcctccaggggtcttcagaccatactttgagaacccatgggctagcgactaccttgagacagtcctttacctaggcctgtggattaaagggtttagctgaaaccctagattcttctctgtagtctaatagaactccaaacattgtaagaattgcttggtagcataagctcagggataaggtgggaattgagttcaaatatagtgttttatcttccacacaaatcatctctataggagttaaattaggaagtcacaacagcgcctgttgaacaaactcatcagtgtggtaatcctatgagggataattgcagaaaggttttagagacttgtgaggttccatatgataattctttacacctccccccccaagagaaagtacacagggctattctgtaatattgttcagggaaatcagcatgatagatgctgtgcctccagagagttctctggagattactacccaaatgtgtattttggcaatttggtggtatttaggatgtaatatgttttcctccatttctgctaattttctctctctctctctcataacatactatacatgctaattgccaagatttgaatgagtcaaa

SEQ ID NO: 194625 - DNA, 1248 bp, Homo sapiens
  Payload ID: 18463
  Gene Name: trimethyllysine hydroxylase, epsilon
  Uniprot ID: Q9NVH6
  ENST ID: ENST00000369439
  CDS Start-End: 88-1218
ggcgggtgaaaggctgcctcccgagactctccttgcttggaattctgcccactctgcggagttagcagtcacgacctccagcacaggatgtggtaccacagattgtcccacctacacagcaggcttcaggacttgctgaagggaggagtcatatatccggcccttccacagcccaacttcaaaagcttacttcctttagctgtccattggcaccatacagcctccaagtctctgacttgtgcttggcagcaacatgaagatcattttgagctgaaatatgctaataccgtgatgcgctttgattacgtctggcttcgagaccactgccgctcagcatcgtgctacaactctaagactcaccagcgcagcctggatactgccagtgtggatttatgtatcaagccaaagaccattcgtctggatgagaccacactctttttcacttggccagatggtcatgtgactaaatatgatttgaattggctggtgaaaaacagctatgaagggcagaaacaaaaagtcatccagcctagaatactatggaatgctgaaatctaccagcaagcccaagttccatcggtagattgccagagcttcttagaaaccaacgagggactgaagaagtttctgcaaaactttctgctctatggaattgcattcgtagaaaatgtccctcccactcaagagcacacagagaagttggcagaaaggatcagcttaatcagagaaaccatttatgggaggatgtggtatttcacttcagacttctccagaggtgacactgcgtacaccaagctagctctggatcggcacactgacactacctattttcaagagccctgtggcattcaagtgtttcattgtcttaaacatgaaggaactggtggcaggacactgctagtagatggattctatgcagcagaacaggtacttcaaaaggcacctgaggaatttgaactcctcagtaaagtgccattgaagcatgaatatattgaagatgttggagaatgtcacaaccacatgattgggattgggccagtcttaaatatctacccatggaataaagagctgtatttgatcagattattcaaagaaaaacaaaacacggtcaacaggcagtggaactcctcactccaatgtgatattcctgagagaatattgacttatcgtcacttcgtctctgggacaagtattgaacataggggaagccttatataaaattgttcaataaacaaaagatgtctttaa

SEQ ID NO: 194626 - DNA, 1220 bp, Homo sapiens
  Payload ID: 18464
  Gene Name: trinucleotide repeat containing 18
  ENST ID: ENST00000328270
  CDS Start-End: 1-1220
ataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggg

SEQ ID NO: 194627 - DNA, 1459 bp, Homo sapiens
  Payload ID: 18464
  Gene Name: trinucleotide repeat containing 18
  ENST ID: ENST00000399434
  CDS Start-End: 160-552
cgctgagtccgcagcgcggggcgaaagagcgggcttctcttgttttaattaaaatcttatcactgcagttgctcttcgaggcagcattggaaggatttctgcccctccaagcttcctttccagggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggaggtaagactggagtccggggttgggggtggcacaggggccttctgagaggcttctggggcctttggcagcatccaggtagcccccagctctgtccaggatgctggctttttttttttttttttttttgagacagggtctcactatgttgcccaggctggagtgcagtggtgcgatcataggtcactgcagcctcaaactcccaaatgatgcacctgactcagccccccaagtagctgggactgcagacacaccccaccacagccagctgactttttaacttttctgtagaggtggagtcttgctgtgttgcccaggatggtttcaaactcctggcctcaagcaatcctcctacctcggctttccaaagtgctgggattacagatgtgagccattgtggcctaagatgcttttttgagacctgagtccctaagaccccccacaggctccttgggcccacccacagccctgggtgccttctggtcacactgtcctcttaggggccctgctaggccttccgggcaactttgaaaacaaaccctggtctctccttttacagatgaggaaactgaggcttgggaagggtagatttaaacttggttgtaggtatttccagagcctgcgctctctagggctgggacgcccatttcttcttgccctggggggtgccttgccttggtgtgaaacctcggggctccctgcaccgaaaccgtttaatttccaagaaaaaacactgggtcgagtgcggctcaagcctgtaatcccagcactttgggtggccgagacgggtggatcacctgaggtcaagagttcaagaccagcctgacgaacatggtgaaaccccacctgtattaaaaatacaataattagccgtgcgtggtggggtgcgcctgtaatcccagctaccggagaggctgaggcaggagaatcgcttgaacccaggaggtggaggttgcagtgagccaaggttgcgccactgtactccagcctgggtgaggagagcgagactctttctgaaaaaaaaaaccaaaaccaaaa

SEQ ID NO: 194628 - DNA, 10572 bp, Homo sapiens
  Payload ID: 18464
  Gene Name: trinucleotide repeat containing 18
  ENST ID: ENST00000399537
  CDS Start-End: 350-9256
ggccgcgggatggcgggcagcaggggcgcctagctgcgccgggagccggggccgccgccggagtcgttgtcgccggagcctggagccgtgaacccagccgcgccagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtggtagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcatggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattggaaaaataaaa

SEQ ID NO: 194629 - DNA, 10562 bp, Homo sapiens
  Payload ID: 18464
  Gene Name: trinucleotide repeat containing 18
  Uniprot ID: O15417
  ENST ID: ENST00000430969
  CDS Start-End: 350-9256
ggccgcgggatggcgggcagcaggggcgcctagctgcgccgggagccggggccgccgccggagtcgttgtcgccggagcctggagccgtgaacccagccgcgccagacgccgtgtgcgccgcctcgcgcagctccgcctggccgcccggaggggccccaccgccggccgcctgtgcgccccgggccgcgggcccgccgccgagcgcaagccccgctggccgccgccatgcacgccgcggagcccccgccgcccgaggactctgggactacgccgaggccgaacttttaggtcccactgagctaggcctgcgggccgggtggggggctgatcgcggcactcccgcggaggatggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccgggctccctgcactctcacgcgccctcggcccggacccctggcggcggccactcctcgggcgccccggccaaaggctcgtcgtcgcgggacggtccagccaaggagcgggcgggccgcggcggggagccgcctccgcttttcggcaagaaggacccgcgcgcccggggcgaggaggcctcggggccacggggcgtggtggacctgacccaggaggcgcgcgccgagggccgccaggaccgggggcccccgcgcctggctgagcgcctgtcgcccttcctggctgagtccaagaccaagaatgcggcgctgcagccgtcggtactgaccatgtgcaacggcggcgccggggacgtggggctgcccgcgctggtggccgaagcggggcgcgggggtgccaaggaggctgcccggcaggacgagggcgcgcggctgctgcggcgcacggagaccctgctccctgggccgcgcccctgcccctcaccgctgcccccgccgcccgcgccccccaaggggcctcctgcaccccccgcggccacccccgccggcgtctacaccgtcttccgcgagcagggccgtgagcaccgcgtggtggcgcccaccttcgtgccttccgtggaggccttcgacgagcgcccggggcccatccagatcgcatcccaggcgcgcgatgcccgggcccgcgagcgcgaggctggcaggccaggggtcctgcaggcgccccccggctccccgcggcctctggaccggcccgagggcctgcgcgagaagaactcggtcatccgctcgctcaagcggccgccccccgcggatgcccccacggtgcgggccacacgcgcctccccggacccccgcgcctacgtgcctgccaaggagctgctcaagcccgaggcggacccgaggccctgcgagcgtgcgccccgcggcccagccggtcctgcagcccaacaggccgccaagctcttcggcctggagcccgggcgccccccgcccaccggccctgagcataaatggaaacccttcgagctgggcaacttcgccgccacgcagatggccgtgctggccgcgcagcaccaccacagccgcgccgaagaggaggccgccgtggtcgctgcctcctcctccaagaaggcctacctggaccctggggctgtgctgccccgctcggcggccacctgcggccggccggtcgctgacatgcactctgcggcccacgggtctggagaggcctcggccatgcagagccttataaagtacagtggcagctttgcccgggacgccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcacttcctgcggcagcaggagttcctgtacctgcagcagcaggcggcccaggccttggaactgcagaggagcgcccagctcgtgcaggagcggttgaaggcgcaggagcaccgggcggagatggaagagaaggggagcaagcggggcctggaggctgcgggcaaggctggcctggccaccgccggccccgggctgctgccgcggaagccccctggcctggccgccggccccgcgggcacctacggcaaggccgtgagcccgccaccatcaccccgcgcatcccctgtggctgccctgaaggccaaggtcatccagaagctggaggacgtgtccaagccacccgcctacgcctaccccgccacccccagctcccaccccaccagcccgccgcccgcctccccaccgcccaccccgggtatcacccgcaaggaggaggctcccgagaatgtggtcgagaagaaagacttggagttggagaaggaagcccccagccccttccaggccctgttctcagatatcccgcccaggtacccgttccaagccctgccaccgcactacgggaggccctaccctttcctgctgcagcccacggccgccgccgacgcggacggcttggcccctgatgtgccgctcccggctgatgggcccgagcgcctggcactctcacccgaagacaagcccatccgcttgtccccctccaagatcacagagccgctgcgggagggcccggaggaagaaccgctggctgagcgggaggtgaaggcagaggtggaggacatggacgagggccccacagagctgccgcctctggagtcgccgctgccactgcccgccgcggaagccatggctacccccagccctgcagggggttgtggaggtggcctgttggaggcccaggcgctgagtgccaccgggcagagctgcgcagagccctctgagtgtccagactttgtggaggggcctgaaccacgggtggattccccgggccggacagaaccctgcaccgccgccctggacctgggggtgcagctgacacccgagacactggtggaggccaaggaggagccggtggaggtgcctgtggcggtgcccgtggtggaggcagtgcccgaggaaggcctggcgcaggtggcaccgagcgagtcccagcccaccctagaaatgtcagactgtgacgtgcccgccggggagggacagtgcccgagcctggagccccaagaggccgtgcctgtactcggcagcacctgcttcctggaagaggcaagctctgaccagttcctgcccagtctggaggacccactggctggcatgaacgccctggcggcagctgcggagctgccccaggccaggcctctgccctccccgggtgctgctggagcccaggccttggagaagctggaagcagccgagagccttgtcttggagcagagcttcctgcatggcatcaccctgctaagtgagatcgcagagctggagctggagaggaggagccaagagatgggaggtgcggagcgggccctggtggcgcggccctccctggagagtctgctggcagctggcagccacatgctgagggaggtgctggatgggcccgtggtggacccactcaagaacctgcggctcccgcgggagctgaagcccaacaagaagtacagctggatgcgcaagaaggaggagcggatgtatgccatgaagtcctccctggaggacatggacgccctggagctggacttccggatgcggctggccgaggtgcagcgccagtacaaggagaagcagcgtgagctggtgaagctgcagcgccgccgggactccgaggacaggcgcgaggaaccccatagaagcttggcacgcagaggccctggcaggccgcggaaacggacccacgccccgagcgccctgtcgcccccccgcaagagagggaagagcggccacagtagcggaaagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgtagcatggtggcaaagaacagcaaggcagctggtggccccaagctgaccaagaggggcctggcggccccccggactctgaaacccaagccggccaccagcaggaagcagccgttttgtctgctgcttcgagaggccgaggcgcgttcctccttcagcgactcttcggaggaatcgtttgaccaagatgagagctcggaggaggaggacgaggaggaggagctcgaggaggaggacgaggccagcggtggtggctacaggctgggtgcccgggagcgggccctgtcaccgggcctggaggagagtgggctgggcctgctggcacgcttcgccgccagcgccctccccagccccacggtgggtccatccctgtctgtggtacagctggaggccaagcagaaggcccggaagaaagaggagcggcagagcctgctgggcacagagttcgagtacaccgactcagagagcgaggtcaaggtgcgcaagcggtcgcctgcggggctgctgcggcccaagaaggggctgggggagccgggaccctccctggccgcacccacgcctggcgcccgcggtcccgaccccagcagcccagacaaggccaagctggcggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaagaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgctgaccccggcccctcgctcctgcatcatcgacaaggatgagctgaaggacggcctgcgtgtgctcatccccatggatgacaagctgctgtacgccgggcacgtgcagaccgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgtccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagccatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggcccaggctgagcaggacggggccgaagagtccgagagcagcagcagcagcagtagtggcagcagtagcagcagcagcagcagcagcagcagcggctcggagacagaaggggaggaggaaggcgacaagaacggggacgggggctgcggcaccgggggccgtaactgcagcgctgccagctccagggcggcctcaccggcctcctcctcctcctcctcatcctcctcctcctcctcctcctcctcctcatcctcctcttcctcctcctcctcttcctcctcctcctcttcctcttcgtcttcctcctcttcctcctcctcctcttcctcgtcctcatcctcctcctcctcctcctcttcctcctcttcttcctccaccacagacgaggactcttcctgcagctcggacgatgaggcagcccccgcccccacggctggcccttccgcgcaggcggcgctccccaccaaggccaccaagcaggccggcaaggcgcggccctcggcccactccccaggcaagaagacgcccgcgccccagccccaggcgcctcctccgcagcccacacagcctctgcagcccaaggctcaggccggggccaagagccgacccaagaagagagagggcgtccacctccccaccaccaaggagctggccaagcggcagcgcctgccgtccgtggagaaccggcccaagatcgccgccttcctgccagcccggcagctctggaagtggttcggcaagcccacccagcggcgtggcatgaagggcaaggcccgcaagctcttctacaaggccatcgtgcgcggcaaggagatgatccgtatcggggactgtgccgtgttcctctctgccggccgccccaacctgccctacatcggccgcatccagagcatgtgggagtcgtggggcaacaacatggtggtccgcgtcaagtggttctaccaccccgaggagaccagcccgggcaagcagttccaccagggccagcactgggaccagaagtccagccgcagcctcccggcggccctgcgggtctccagccagaggaaggacttcatggagcgcgcgctataccagtcctcgcatgtggacgaaaatgacgtgcagacggtgtcgcacaagtgcctggtggtgggcctggagcagtatgagcagatgctgaagaccaagaagtaccaggacagcgagggcctgtactacctcgcgggcacctacgagcccaccacgggcatgatcttctccacggacggcgtgcccgtgctctgctgagcccgccgggccctgcgggccacctgtgccccgagggcggccagggacccatctccatcactgccatggcgcggagaccacgtgcgttgtgtgcatgcgagcgctcctgcaggcgtgtgcatggggccaggtgtgcacgtggatgcccgggtgagtgtgtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcatggagcccaccccaaggcctcccaccgtgcatgggacagggcagcccgatgccagctggcctacctgactgtgccaggggccctgcccccaccctctcaggatggcctagacttggggaacagagccgggtggggttgcagcccggagtgtctgtcaaaggcaccaggtggagagggcccggcacaggcccaccctggtccaaaccctcacactacagaaaaccccaatggtgctgaaactgtcgcccggccacgcctggcccctccccacccaggagggaggtggcacttcttaacctgtacagttttattgtaccaagagactcgccccgcccctgtatcataagcctttaaatggagtcaactttttaattatatatataaagataaatatatataaatatatatataaactttttaaaactgtgaaaaatagctatgaaattataaaaaaaaacattctgacgtgcagaatattattttttatttcctgttagattatagtgtctagcaccggcttcaccggcctcccagtccccagcacaccccccgcccaccccaccaagtgtactgtactcaccccccaggatagagaagtgtttgttagggagagaagagggagaggcaggagccggcccaagcccagggtccctgcttgggccccagaaagcacttaaccaggccccaagccttcaagggaaaccaaggcctcaaccagacaatcttgagggaaggaaaagccagactttgggtttgttttttgggggaattattggtttttttttttatgtttcttttggaattttgtttgttggcaaattctgtgtgatcttttttcataaaaaaaaagaaaagatttaattgg

SEQ ID NO: 194630 - DNA, 757 bp, Homo sapiens
  Payload ID: 18464
  Gene Name: trinucleotide repeat containing 18
  ENST ID: ENST00000440081
  CDS Start-End: 1-757
gccatgaagtcctccctggaggacatggacgccctggagctggacttccggatgcggctggccgaggtgcagcgccagtacaaggagaagcagcgtgagctggtgaagctgcagcgccgccgggactccgagctgagcagcaagtctctgctgacatcagatgattatgagctgggagcagggataagaaagagacacaaggggtctgaggaggaacatgatgccctcatcggaatggggaaagccagggggaggaaccagacttgggatgaacatgaggcctcgtcggacttcatcagtcagctaaagattaagaagaagaagatggccagcgaccaggagcagttggcaagcaagctcgacaaggccctctccctcaccaagcaggacaagttgaagtcgcccttcaagttttcggacagtgctggggggaaatcgaaaactagcgggggctgcggcaggtacttgactccttacgacagcctgctggggaagaacaggaaggcgctggccaagggcctcggcctgtctctgaaatcctccagagaaggtaaacacaaaagggcagccaaaaccaggaagatggaggtggggttcaaggccagaggccagcccaagtcggcccattccccgtttgcctcggaagtgagcagctactcttacaatacggactcagaggaagacgaagaattcctgaaggacgagtggcccgcccaaggcccctccagctccaaactgacgccttccctcctgtgta

SEQ ID NO: 194631 - DNA, 577 bp, Homo sapiens
  Payload ID: 18464
  Gene Name: trinucleotide repeat containing 18
  ENST ID: ENST00000455076
  CDS Start-End: 1-577
cggtggagaaggggcgcaaggcccggaagctgcggggccccaaggagcctggcttcgaggcggggcccgaggccagcgacgacgacctgtggacgcggcgccgcagcgagcgcatcttcctgcacgacgcctcggctgctgcacctgcgcccgtcagcaccgcgcccgccaccaagaccagccgctgcgccaagggcggccccctgagcccgcgcaaggacgccgggcgtgcaaaggacaggaaggaccccaggaaggttcctgctacagtatcaaaaggcagacactggaagaagaaagggaaagaggctgggccaggagctgggctgccgccgccccgagctcctgccttgccctctgaggccagggctcctcacgccagctccctgaccgctgccaaaaggagcaaagccaaggccaaagggaaggaggtgaagaaggagaaccgcggcaaggggggtgccgtgagcaagctgatggagagcatggcagccgaggaggactttgaacccaaccaagactcgagcttctctgaggacgagcacctgccgcgtggcggggctgtggagcggccgct

SEQ ID NO: 194632 - DNA, 577 bp, Homo sapiens
  Payload ID: 18464
  Gene Name: trinucleotide repeat containing 18
  ENST ID: ENST00000434361
  CDS Start-End: 281-577
gtgggcctccctcctccctggggccagcccccaggctctcctgccccaggtggggcagggctgaagcgggttgatctgggctggtggctactgcagtcttggtcctggttctggtcccagcatagcttggaggagactgcagcctcggactctcacctgcctcttttctgcgccgatgggagttccagaacggcggcggtggccacaggtctgatagcccagccgcagtgccaaggacgtgcagggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaaggcttctcccacctgcccagtgggctgtacccatcctacctccacctgaaccacctggagccccccagcagtgggagccccctcctcagccagctgggtcagcccagcattttcgatacccagaaaggtcaggggccaggaggagacggtttctacctgcccaccgcgggggctccg

SEQ ID NO: 194633 - DNA, 925 bp, Homo sapiens
  Payload ID: 18464
  Gene Name: trinucleotide repeat containing 18
  ENST ID: ENST00000413081
  CDS Start-End: 1-925
gccgtggccgtgcgccctggtggctgtggcaagaagagcccctttggaggtttgggcaccatgaaacccgagcctgcgcccacctctgcgggtgcctcccgagcccaggcccgtctcccacactccggaggccctgcagcgggcggcggccggcagctgaagcgggaccccgagaggcccgagagcgccaaagctttcgggcgcgagggctctggtgcccagggtgaggcagaagtgcgacacccgcctgtgggcattgcagtggctgtggcccggcagaaggacagtggcggcagtggccggctggggcctgggctggtagaccaggagcgctctctgtcgctgagtaacgtcaaagggcacggccgagcagatgaggactgtgtggacgaccgggccagacaccgggaggaacggctgctcggggcacggctggaccgggatcaggagaagctgctcagagagagtaaggagctggctgacctggcccgcctgcaccctaccagctgtgctcctaacggcctgaaccccaacctcatggtgacggggggcccggcgctggcgggctcaggtcgctggtctgccgaccccgcagcccatctggccacgcacccctggttgccccgctcgggcaacgcatccatgtggctcgctggacacccctacggcttgggtcccccatctctgcaccagggcatggcccctgcgttcccacctggcctggggggctccctcccgtcagcctaccagtttgtcagggacccccaatcgggccagctggtggtcattcccagtgatcaccttcctcactttgcggagctgatggagcgggccaccgtaccgcccctctggcccgccctgtacccgccgggccgcagccccctgcaccacgcccagcagctgcagctcttctcacagcagcact

SEQ ID NO: 194634 - DNA, 8303 bp, Homo sapiens
  Payload ID: 18465
  Gene Name: trinucleotide repeat containing 6A
  Uniprot ID: Q8NDV7
  ENST ID: ENST00000315183
  CDS Start-End: 148-5889
ggcggcggcggcggcggcggcggcagcgggtcggtgtagaaaatggcgctggtgcagcggctcgggcctctccccgcggcgctgcggagggcttgaggctcgcgagcctccttcgccgcgccccacttgctcgtgcactttacacacatgagagaattggaagctaaagctaccaaagacgtagaaagaaatcttagcagggatttagtgcaagaagaagaacagttgatggaagaaaagaaaaagaaaaaagacgacaagaaaaagaaggaagctgctcaaaagaaggccactgaacaaaaaatcaaagtgccagaacagataaagcccagtgtaagccagcctcagcctgccaactctaataacggcacttccacagcaaccagcactaataataatgccaagcgagctacagccaacaatcagcagccacagcagcagcagcaacagcagcagccgcagcagcagcagccacagcagcagccacagccgcagccgcagcagcagcagccacagcagcagccacaggccttgcctcggtatcctcgtgaagtacctccacgatttcgccaccaggaacacaaacagcttctaaagaggggtcagcattttcctgttatagcagcaaaccttggatctgctgttaaggtgttaaacagccagtcagaaagcagtgctttaacaaatcaacagccacaaaataacggagaggtgcagaacagcaaaaaccagtcagatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaattt

SEQ ID NO: 194635 - DNA, 8438 bp, Homo sapiens
  Payload ID: 18465
  Gene Name: trinucleotide repeat containing 6A
  Uniprot ID: Q8NDV7
  ENST ID: ENST00000395799
  CDS Start-End: 130-6018
ggcggcagcgggtcggtgtagaaaatggcgctggtgcagcggctcgggcctctccccgcggcgctgcggagggcttgaggctcgcgagcctccttcgccgcgccccacttgctcgtgcactttacacacatgagagaattggaagctaaagctaccaaagacgtagaaagaaatcttagcagggatttagtgcaagaagaagaacagttgatggaagaaaagaaaaagaaaaaagacgacaagaaaaagaaggaagctgctcaaaagaaggccactgaacaaaaaatcaaagtgccagaacagataaagcccagtgtaagccagcctcagcctgccaactctaataacggcacttccacagcaaccagcactaataataatgccaagcgagctacagccaacaatcagcagccacagcagcagcagcaacagcagcagccgcagcagcagcagccacagcagcagccacagccgcagccgcagcagcagcagccacagcagcagccacaggccttgcctcggtatcctcgtgaagtacctccacgatttcgccaccaggaacacaaacagcttctaaagaggggtcagcattttcctgttatagcagcaaaccttggatctgctgttaaggtgttaaacagccagtcagaaagcagtgctttaacaaatcaacagccacaaaataacggagaggtgcagaacagcaaaaaccagtcagatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaattttttaaa

SEQ ID NO: 194636 - DNA, 3700 bp, Homo sapiens
  Payload ID: 18465
  Gene Name: trinucleotide repeat containing 6A
  ENST ID: ENST00000450465
  CDS Start-End: 1-2721
caacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaa

SEQ ID NO: 194637 - DNA, 587 bp, Homo sapiens
  Payload ID: 18465
  Gene Name: trinucleotide repeat containing 6A
  ENST ID: ENST00000569098
  CDS Start-End: 1-483
agtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatttcagatcttttcctgctgaccctttgatttcaaatgtgcagaggggtgtctcggaacaaaagccagaactggaacccatatggaccttgacagagaccaggccttcagccctggcggaactttgcatgaat

SEQ ID NO: 194638 - DNA, 609 bp, Homo sapiens
  Payload ID: 18465
  Gene Name: trinucleotide repeat containing 6A
  ENST ID: ENST00000568750
  CDS Start-End: 1-609
atcaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcac

SEQ ID NO: 194639 - DNA, 610 bp, Homo sapiens
  Payload ID: 18465
  Gene Name: trinucleotide repeat containing 6A
  ENST ID: ENST00000569376
  CDS Start-End: 1-290
cccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggttttgttacatctggacttactactgatgtagcccagatcggcgtgcttagactgacgtgtgcggatgagaaggaatgcagaagtgattgaggaaaagttaagcatgaagtcttgggcaaaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcag

SEQ ID NO: 194640 - DNA, 7956 bp, Homo sapiens
  Payload ID: 18465
  Gene Name: trinucleotide repeat containing 6A
  ENST ID: ENST00000491718
  CDS Start-End: 1-122
caaaccttggatctgctgttaaggtgttaaacagccagtcagaaagcagtgctttaacaaatcaacagccacaaaataacggagaggtgcagaacagcaaaaaccagtcagtgaataagtagcagatcctggactcacatcaagatctgtctgactccaaagatatgcttgtaaccaccatgctgtgctttggcaacatacaggatgtgattggtaatgaggaagaggacacaaatatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaattttttaaa

SEQ ID NO: 194641 - DNA, 15958 bp, Homo sapiens
  Payload ID: 18466
  Gene Name: trinucleotide repeat containing 6B
  Uniprot ID: Q9UPQ9
  ENST ID: ENST00000301923
  CDS Start-End: 303-3392
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagc

SEQ ID NO: 194642 - DNA, 17933 bp, Homo sapiens
  Payload ID: 18466
  Gene Name: trinucleotide repeat containing 6B
  Uniprot ID: Q9UPQ9
  ENST ID: ENST00000335727
  CDS Start-End: 195-5366
gagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagca

SEQ ID NO: 194643 - DNA, 3444 bp, Homo sapiens
  Payload ID: 18466
  Gene Name: trinucleotide repeat containing 6B
  Uniprot ID: Q9UPQ9
  ENST ID: ENST00000402203
  CDS Start-End: 236-3325
cggcccgcggaggcgcgtccgcccctggctggcggtggcagagggaggcgtcaggcctcggatcctcgggtccctgcgcagcgtcccggcctgtgtgcaggacctgcgtgacaagggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaa

SEQ ID NO: 194644 - DNA, 415 bp, Homo sapiens
  Payload ID: 18466
  Gene Name: trinucleotide repeat containing 6B
  ENST ID: ENST00000441751
  CDS Start-End: 303-415
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaaca

SEQ ID NO: 194645 - DNA, 18279 bp, Homo sapiens
  Payload ID: 18466
  Gene Name: trinucleotide repeat containing 6B
  Uniprot ID: Q9UPQ9
  ENST ID: ENST00000454349
  CDS Start-End: 212-5713
agagacagagagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagctgactttgcctttctccaatcaagatgggtgccttggggatgaggctccctgctctcccttctccccttctcccagctacaagctgtctccctctggttccacactacccaacgtcagccttggagcaatcggcacagggctcaacccccaaaacttcgctgctagacaaggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctctttgtcttgggcaaatagaaggggttcctgttgttctgctcttgtccttcgtctcctccccttttcccccagacctcccccttctttttgtcaacttgctgggagctttgctttattggttggcagtgacctaagaacaggatatggtgaggatgtcatggaagagaagagctctttccgtggtattctttggcaagagccatgtctactaagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcgtgtggccaccgggaccagatcccgagtgattgtggcatacccctaatatttgagtagtttttaagctgtcagtctcttgtcataacctcctaccgccacccaaaaaagtaacgaaagttgcagtaactgccagtgtttgcctcaccaaatttaaatcgttcccttttcagttagctatatacctgaatttgtttttaacaagaaactgtacatggccaggaaaaatggtactaccttggccaaagggtctttgcaaaaagctcagtcttcagttcttcactgtgacaaatgcttatcttgttcatgggaggggaaagatcagataaataggcaagaagtactctgttttaaataaagaataaatagtgtccgtttaaagcactttgtgcctcaacttcatttttaaactgtaaatcattgctttggaaataaattcccaattataattgacccatatctagccaatatcaacaagttgggatggtttttgtttttttcttttttttcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgcttgaacccgggagacggaggttgcggtgagccgagattgcaccactgcactccagtgtgggcaacagagcaagacttcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctggggggcgtagcagaggaggataggtagagaagtaccattttaattatttgtgacttgtggcttccttcctcctctcctcctccctccacgtctctctttgccccctttagacagaaggtgcagaaaagggcatcaaaaagaggctggattttttaaaaggcagctttccaactttgcacacaaacaggtaacaggaaggtacagcaaaaatcctctcatctgaaacactgtcagcagaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagc

SEQ ID NO: 194646 - DNA, 4741 bp, Homo sapiens
  Payload ID: 18466
  Gene Name: trinucleotide repeat containing 6B
  ENST ID: ENST00000446273
  CDS Start-End: 1-4175
tctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagtctggagcaaaagcacaccacctgctccagataatggtacttccgcttggggtgagccaaatgaaagcagtcctgggtggggcgagatggatgatacaggagcatcgaccacaggctgggggaacacgcccgccaacgctcccaatgccatgaagcctaattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgagtattcggtcctacacccacgtagacaaacatgcatgaagatgcacccgtgagtattctggcagctgctgaattaaagatgcaccagaacatatacgaagaatggcaccgtcacacgtgcatctgcaagtctcgagtgtggagagtgtggaggtgccgggtcttttccaccaaagcttggattgtcctgtatatatcagaggccagtcgtcagaattccaaacgtaaataatttgtgaagtagtgagtaaattctaagtaacataaagctagggccgggcacagtggcccatgcctgtaatcccagcactttgggaggccaaggcgggcagatcacaaggtcaggagatggagaccatcttggccaacatggtaaaaccctgtctctactaaaacacaaaaaatcagccaggcgtgggggcgcatgcctgtagtcccagctactgggaaggttgaggcaggggaatcgcttgaacctgggaagcagaggttgcagtgagctgagatcatgccactgccctccagcctggtgacagagcaagattccatctcaaaaaagaaaaaaaa

SEQ ID NO: 194647 - DNA, 9632 bp, Homo sapiens
  Payload ID: 18467
  Gene Name: trinucleotide repeat containing 6C
  Uniprot ID: Q9HCJ0
  ENST ID: ENST00000301624
  CDS Start-End: 570-5642
aggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaagtaatgtgtttttcatttttcaaaagacactatggatgtctactttgcacgctgcgattgggagagctgtcccgctgcatgcgttccctctgtaatttcctcagagctcacatacgtacctctctcacgagtgaactcagattttccattgttttgctttattctatcatttgctttgtggttttgctgtaaatattgaaatcttaatcatcatcgagaggcacagccaagctttccagctctccacccccgtggcccatccaagtctgttcatctggtaacttctgttgtctgggacggcagcaagaagatgccggggcttgcctggagtcctggcagaggagtgccactcacttttgcctagggtccagttggggcttaaaaaatatttggagagaagagtaatgaggattttttgtgtttcctagacattttatgcatctatttttgtaaaatcaccttcgctaactttcaccaagcactttgagcacagtggaacttcagaagcacaaccagcctaaccccagaatctcaggtggcacagctagaaattgagtcccttcctaggacactggccgtggccttcagggtgaccagtcagtgccaccgggttggcattggtgttacagacaggcctctgaagacaaaccgagcaccccagcggcccctcaaactaagcaaggatcttttttctgtctgcgctccctggggcaaggtcaaaggtggacccgcccactgtgggtcaattccttcgaaaagatgggacccgcacccccgccacaggctggcccccccccacccatggggaaggtggtgtgctgctggctctgaccatactcttttggaaattgagaaggaaagcattgagtgggacctaatccggagaagaaattaaagaccagaaaaagaaggaagctgggaatgaaactcaaaatgcacttgaacctggaagcggcaaccctcagctctgcgcggccgagcctcagcaagagttcgttttgtgcctgagttactactacaggggcaaactgtacccgtgcctgtgcgctgggagaacaaggtcagcgcccaagggtgtgcaaaggatgtggcaggcttcatggaggaggtggcatttgccctgggcctgggagaccaggttggattttgacagactgggaactcgggggacaggagggcagcacagtgtaagctaaagccctgtgtagggaccccacgcaaagacctcgtgggcctgggtgtccagggcaccatttccacccatgggtgaaaaagaggcttgaggaagacaacaggttcttcacctgcatctgtggatatatatttttttaagtttattaaatttttttttaaatggcagtttcagacctgc

SEQ ID NO: 194648 - DNA, 9740 bp, Homo sapiens
  Payload ID: 18467
  Gene Name: trinucleotide repeat containing 6C
  Uniprot ID: Q9HCJ0
  ENST ID: ENST00000335749
  CDS Start-End: 570-5750
aggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaagtaatgtgtttttcatttttcaaaagacactatggatgtctactttgcacgctgcgattgggagagctgtcccgctgcatgcgttccctctgtaatttcctcagagctcacatacgtacctctctcacgagtgaactcagattttccattgttttgctttattctatcatttgctttgtggttttgctgtaaatattgaaatcttaatcatcatcgagaggcacagccaagctttccagctctccacccccgtggcccatccaagtctgttcatctggtaacttctgttgtctgggacggcagcaagaagatgccggggcttgcctggagtcctggcagaggagtgccactcacttttgcctagggtccagttggggcttaaaaaatatttggagagaagagtaatgaggattttttgtgtttcctagacattttatgcatctatttttgtaaaatcaccttcgctaactttcaccaagcactttgagcacagtggaacttcagaagcacaaccagcctaaccccagaatctcaggtggcacagctagaaattgagtcccttcctaggacactggccgtggccttcagggtgaccagtcagtgccaccgggttggcattggtgttacagacaggcctctgaagacaaaccgagcaccccagcggcccctcaaactaagcaaggatcttttttctgtctgcgctccctggggcaaggtcaaaggtggacccgcccactgtgggtcaattccttcgaaaagatgggacccgcacccccgccacaggctggcccccccccacccatggggaaggtggtgtgctgctggctctgaccatactcttttggaaattgagaaggaaagcattgagtgggacctaatccggagaagaaattaaagaccagaaaaagaaggaagctgggaatgaaactcaaaatgcacttgaacctggaagcggcaaccctcagctctgcgcggccgagcctcagcaagagttcgttttgtgcctgagttactactacaggggcaaactgtacccgtgcctgtgcgctgggagaacaaggtcagcgcccaagggtgtgcaaaggatgtggcaggcttcatggaggaggtggcatttgccctgggcctgggagaccaggttggattttgacagactgggaactcgggggacaggagggcagcacagtgtaagctaaagccctgtgtagggaccccacgcaaagacctcgtgggcctgggtgtccagggcaccatttccacccatgggtgaaaaagaggcttgaggaagacaacaggttcttcacctgcatctgtggatatatatttttttaagtttattaaatttttttttaaatggcagtttcagacctgc

SEQ ID NO: 194649 - DNA, 576 bp, Homo sapiens
  Payload ID: 18467
  Gene Name: trinucleotide repeat containing 6C
  ENST ID: ENST00000588549
  CDS Start-End: 290-576
gatgcaggcgtagaggcagctgtgcacgcgaggtggcgtctcctaggagggttgggcggcaccgtctgcagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcat

SEQ ID NO: 194650 - DNA, 682 bp, Homo sapiens
  Payload ID: 18467
  Gene Name: trinucleotide repeat containing 6C
  ENST ID: ENST00000585438
  CDS Start-End: 333-682
aacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaa

SEQ ID NO: 194651 - DNA, 8527 bp, Homo sapiens
  Payload ID: 18467
  Gene Name: trinucleotide repeat containing 6C
  Uniprot ID: Q9HCJ0
  ENST ID: ENST00000588847
  CDS Start-End: 728-5908
agggagaaagagcaagaaacacaagaagaggaacgtttgatggaagaaaagaaaaagaaaaagcaggaagaaaagaaaaagaaggaaggtgctcagaaaaaggctgctgatcaaaaaaccaaagattggtttctgatactaaattggcctctagagttgggcagaaagactcatcgctacagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaag

SEQ ID NO: 194652 - DNA, 8419 bp, Homo sapiens
  Payload ID: 18467
  Gene Name: trinucleotide repeat containing 6C
  Uniprot ID: Q9HCJ0
  ENST ID: ENST00000588061
  CDS Start-End: 728-5800
agggagaaagagcaagaaacacaagaagaggaacgtttgatggaagaaaagaaaaagaaaaagcaggaagaaaagaaaaagaaggaaggtgctcagaaaaaggctgctgatcaaaaaaccaaagattggtttctgatactaaattggcctctagagttgggcagaaagactcatcgctacagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagagaggccagccattgcctacggggactctaaccagtgtgagcccaacccagggtgctgggcctgcaggggtaagcccacctcccctacctggagccggaacacagcatcatcccagtaagctccaaccagatctcagtcatagtggattggcagatcattatgaaaattcccactggggacagcagcctacttacagaagcgaagccaactgcagctgggataaagtgataatagataggactgacaaggaggcgtggccttccatcacaggaacagagactgaatctgcctcagaatgtactacagacactgactctgcctccaactgtggctcagagaacagtagcatggctacagggagtgcccagggcaacttcactggacataccaagaagacaaatggcaataatggcaccaatggcgcactcgtccaaagcccttctaatcagagtgcccttggagcagggggagcgaacagtaatggaagtgcggccagagtgtggggtgtagccacaggctccagctctggcctggctcactgctctgtcagtggtggggatggaaaaatggacactatgattggagatgggagaagtcagaattgctggggtgcttccaactccaatgctggcattaatcttaaccttaatcctaatgccaacccagctgcctggcctgtacttggacatgaaggaaccgtggcgacaggcaacccttccagtatttgcagtccagtcagtgccataggtcaaaatatgggcaaccagaacgggaacccaacaggcactttaggtgcttggggaaacttgctgccacaagagagcacagaaccacaaacgtccacttctcagaatgtgtctttcagcgcacaacctcagaaccttaacactgatggaccaaataacactaaccccatgaactcttcacccaaccctatcaatgcaatgcagacaaatggactgccaaactggggcatggctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgcagagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggaatggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagcagcggccgcccttttgagtacctctgtccaggactgaagacgaaccttggccgcagtccttgcgaactgttcgcaaaacagtgcgggctgcggtgggtcagcgtcacatgctaatgacaggatgttcctcgtagctttttattttgtgcgtcttatgtttgtatagtgtgttgtcattttgattttttttttttttttaagtataaaagctgcttagaatagttctatcatgaagggcacttttcagattgtgggctggaaagggttattttatctgtgggggagggagggagacgtgaagcctatttaaaatgagcctgtgacgattatgcacatgaccagaggcggccggtaatcagggcagagtctggtgtggaccgccgggcgcagagcggctccgcggcgggagctgagcggaaggcgcgggctgcgatctgctctctgttcccctggatccgcctatgcacattacccttgtttcattactttttcatgtcatttttttatcccaaaaaatattttttaaaagttaaaaaaagacatatcaaacatgcaaatacttgaatccagcaggccaatagtgaaatgtgaacactttctaattctacacttccaggttgacatcagtacacagaaacaggctctaggaaaaatttctaagttcatagcctacgtgtgtgtatgtgtgcgtgttgaaacagaagtgtgtgtgtgtgtgcatgtgtggcgcgtgctcctgcacggcgtgcagttttctgtgtttgtgtgtttgaaagcgtgtgaggatttaactgtgggttttcccttgtattcagtatacgctttttttttggcgcattggtcaaacggttgttattattagcttctaactttgcactgagtgtcctcgcccttcctttagctaatcctatacattacagagaattcctaggacagggctggcgacaattcatgtgtaaatgtttactcaaggactctgtgactgcgtttaaaaagtacagtgtatatctctggagaaataacatgtatacctacctttagcagctttttattgtggactaatgcaagaaaattattaccagagtattgcaccatttttccatttggaatataaagttaaagagaaaaaaaaaaaaaactgttgttgaactgtggccatagatacttgtaaagaatggatggttccgtggaaggaacagaaacaagcacttgggcgtgggttgtgactgcttttgggggagcctggggtttgggctcccacctgtttacagacctttttttctccttcagactttaaaattttaaaaatttaaaaaggaattaaaaaaaaaaaaagacttccgtcgtaaagaaacctattttcagaatgcagatgcgttccttcagagctctgggacgggacagtgttgttccctcggccatcgtcgtggactctgtcgattgctttcgccccttcgtcaaggtgacaggcgttgtggccactgtcttgcacatgccggacgcgctctcaggaaagccagggctcccgagggcagctccacaccatttcatgtatttttaaacccaactcctagcactgaagatgttatttaaaaaaaaaaaaaacaaaacaaaacaaaaaaatgaaaaaaaagaaaaagaggaaaaaaaaacacaaagaagaaaaatacctaatctctaatgtgtagcagttacatatttaccaaataatggactcaaaagaaatagatgtttgaagagtgctttatatattaaaaattgctttatgttttaaaaatgatcaatgttttgattgttttgcaaggaagaaagacaatggaataacataccttcaagtatgttttaaaaaatatatatatgaacattgtgctccctgcctgcttgatcaggaaacttgtgcattacatttttttaattagctttttaatggttttatcaaaacaaaaaaaatacaaaaaaaaaaaaaaaagtcctgcaagactgcagatccacaaaagctggttttatagaggatcatgaactatgcacaaactgggttcaagactttttttctcaagtttagtaggatatttagaaaaaccaaccttcctcagagtgactgcatctcattgccattacatgcgttctatatattcgatggacatacacctgcgtatgtatatccaatatgtgtgcgtgtgagcatgcgtgtgcgtatgtgcgtccgacataccacttcccgtgctgccggcgagcattgagttgtagaaaaactgttgttttaaaattggggatggaagtcaagaatatgtttgtttgtttttgggttttgttgggtttgaggggttttttgtttgtttgttttttgttttttttaccttttattttgaacttaatatgtctgtaactctgagattaaacaacaagttcgtggctcttaatgttttcctcatagaatgtgactgttgaagaacatgcatcgaaagttgctttcgaaagtacaacgctttattgaatcttaataaattgcaatttttttcttggctgttcaaag

SEQ ID NO: 194653 - DNA, 7300 bp, Homo sapiens
  Payload ID: 18468
  Gene Name: TRIO and F-actin binding protein
  ENST ID: ENST00000344404
  CDS Start-End: 137-451
cccaggggaggaggtgaaattcctcagctctccaccaagattggccacaaaagcctgatcccctggaacacagcaggcctcacatagacggtcagccattggatcataggaactgccctggcctgactcacccaatatggaggaggtgcctggggatgccctgtgtgaacactttgaggccaacatacttacccagaaccgctgtcaaaactgcttccaccctgaggaggcccatggagcaagataccaggagctcaggagcccttcaggtgctgaggtgccctactgcgacctgcctcgatgtccacctgcccctgaggacccactcagcgcctcaacctccggctgccagtctgtggtggacccaggcctcaggccagggcccaagaggactgggacactgttgagaggcaggaggaggaggcccccagctgggacgagctcgcagtgatgatcccgaggaggcctcgggaggggccgagagctgacagctcccaaagggctccgtctctcctcaccaggtcccctgtgggaggagatgctgcaggccagaaaaaggaggacaccggcggtgggggccggagcgcaggacagcactgggcaaggctccggggagaaagcgggttgtccctggagcggcaccggtcaacactgacccaggcttcctccatgacaccacacagtggacctcgaagcaccacgtctcaggcttctcctgcccaaagggacactgctcaggctgcctctacacgtgaaatccccagagcctcctctccccatcgaatcacccaaagggacacctccagggcctcatccacccaacaggaaatctccagggcctcatccacccaacaggaaacctccagggcctcatccacccaagaggacacccctagggcctcatccacccaagaggacacccccagggcctcatctacacagtggaacacccccagagcttcctctccctcacgaagcacccaactggataaccccagaacctcttctacccagcaggacaacccccaaacttcttttcctacttgtactccccagcgggaaaaccccaggacaccctgtgtccagcaggacgatcccagagcctcctctcccaacagaaccactcaacgagagaattccagaacatcctgtgcccagcgggacaatcccaaagcctccagaacctcctctcccaatagagccacacgagacaaccccagaacatcctgcgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgtgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgcgcccagcgggacaatcccagagcctcctctcccaatagagctgcacgagacaaccccacaacatcctgtgcccagcgggacaatcccagagcctccagaacctcctctcccaatagagccacacgagacaaccccagaacatcctgtgcccagcgggacaatcccagagcctcctctcccaatagagctacacgagacaaccccacaacatcctgtgcccagcgggacaatcccagagcctccagaacctcctctcccaatagagccacacgagataaccccagaacatcctgtgcccagcgggacaatcccagagcctcctctcccaacagaaccacccaacaagacagccccagaacatcctgtgcccgacgggacgatcccagagcctcctctcctaacagaaccatccaacaagagaaccccagaacatcctgtgccctacgggacaatcccagagcctcctctcccagcagaaccatccaacaagagaaccccagaacatcctgtgcccaacgggacgatcccagagcctcctctcctaacagaaccacccaacaagagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacgagacaaccccagaacatcctgtgcccagcgggacaatctcagagcctcctctcccatcagagccacccaacaggacaaccccagaacttgtattcaacagaacatccccagatcatcttctacccaacaagacaaccctaaaacctcttgtaccaaacgagataacctcagacccacttgtacacagcgggaccgcacacagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcccctcgagcctcttcgccccctcgctatttgcagcacgaccccttccccttcttcccagagccccgcgcccctgagagtgaaccgccccaccacgagcctccctatataccacctgctgtgtgcattggacaccgagatgccccccgggcgtcctcgcccccccgccacacccaatttgaccccttccccttcctcccagacacatcagatgccgagcatcagtgtcagtccccccaacacgagccccttcagctccctgcacctgtgtgtattgggtaccgagatgcaccccgggcctcctccccaccacgccaggccccagagccttccctcttattccaggacctccccagggccagcacagagagccttgtcccttccatggactctctgcacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccacagccctggccgtgcagaggtggagcgcctcttcgggcaagagcgcaggaagtccgaggcagcgggggccttccaggcccaggacgagggacggtcacagcagcccagccaaggccagagccaacttctccgaagacagtccagccctgcccccagcaggcaggtgaccatgctccctgccaaacaggcagaactgacccggcggagccaagcagagccccctcatccttggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcagttccaaccagaggagcctgaggagtcagaaccaagcagaggccaagaccccctgactgaccagaagcaggcagactcggcagacaagaggccagcagagggcaaggctgggagcccgctcaagggccgactggtgacctcatggcggatgcccggggaccggcccacgctgttcaatccgttcctgctgtctctgggggtcctcaggtggcgaaggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcac

SEQ ID NO: 194654 - DNA, 2125 bp, Homo sapiens
  Payload ID: 18468
  Gene Name: TRIO and F-actin binding protein
  Uniprot ID: Q9H2D6
  ENST ID: ENST00000407319
  CDS Start-End: 11-1306
aaaaagttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacagctggtgggcgtgatcactgtgcccgttttacagacaaggccactgagctctgagaggttatgtgacttgcccaaggtcaccccgcctgcaggtctcaaaggtgggatttgagcgagggtccggctgactgcagagcctgtgtgtgagtccccgtgtgacactctgcacttggacccttgccccggggaagtggggggctagtggccccgagagtcactccctgaacacagggaaatcctgccgaggcccactgggccaaggccccacacaaggaggtctgcaggacaggggagcctccagtagccctcagagaatgcaccgtccgcctaggacagcggttctcaacggggtccattttgtcccccttggggacatttggctgtgtctgggaatacttctggttgtcacaactaggacaaactaactctctagaaaaaacgtgtgtgtgtacacatatataagtttattataaattttaccaataaaaacaatgcttagtacacaatttacaaataaaaatatataattttattgtgaattccgtacagcaaatggatttttctcagaatgctttcagtgattttttccatactcttgtatccacaactgattaacaaagggggttgttctaacgtgtgctggttgacatttttgtttatggtaatgagtaagatgagaagacatttgtcgaaactttactggtccatgttgtcagctacttctttgctagatcggatagtagttttctattgagaatatttgagaatattctattaagaatatttttgcaattttttgttctatttacaatgtaatggttatagatgtgagatacttctaagtttaatctgcattattagcattttcttatcacttgcttaagtctagacaatcaacaaaacaataaatcaagccctgatgtgtaatgtt

SEQ ID NO: 194655 - DNA, 10129 bp, Homo sapiens
  Payload ID: 18468
  Gene Name: TRIO and F-actin binding protein
  Uniprot ID: Q9H2D6
  ENST ID: ENST00000406386
  CDS Start-End: 256-7353
atcgctctgattcattgttaaaataaagaggccatgaccctggcactcccaccccggcagcccctgtgcgtggaaacccagccaaggtctgatgatggaggagccttggccctggctgtcccaggggaggaggtgaaattcctcagctctccaccaagattggccacaaaagcctgatcccctggaacacagcaggcctcacatagacggtcagccattggatcataggaactgccctggcctgactcacccaatatggaggaggtgcctggggatgccctgtgtgaacactttgaggccaacatacttacccagaaccgctgtcaaaactgcttccaccctgaggaggcccatggagcaagataccaggagctcaggagcccttcaggtgctgaggtgccctactgcgacctgcctcgatgtccacctgcccctgaggacccactcagcgcctcaacctccggctgccagtctgtggtggacccaggcctcaggccagggcccaagaggggcccatccccctcagcagggctcccagaagagggtcccacagctgcccccaggagcaggagccgggagcttgaggcagtaccctatctggagggcctgaccacttccttgtgtggcagctgcaacgaggaccccggctctgaccccacctccagccctgactccgccacccctgatgataccagcaactcgtcctctgtggactgggacactgttgagaggcaggaggaggaggcccccagctgggacgagctcgcagtgatgatcccgaggaggcctcgggaggggccgagagctgacagctcccaaagggctccgtctctcctcaccaggtcccctgtgggaggagatgctgcaggccagaaaaaggaggacaccggcggtgggggccggagcgcaggacagcactgggcaaggctccggggagaaagcgggttgtccctggagcggcaccggtcaacactgacccaggcttcctccatgacaccacacagtggacctcgaagcaccacgtctcaggcttctcctgcccaaagggacactgctcaggctgcctctacacgtgaaatccccagagcctcctctccccatcgaatcacccaaagggacacctccagggcctcatccacccaacaggaaatctccagggcctcatccacccaacaggaaacctccagggcctcatccacccaagaggacacccctagggcctcatccacccaagaggacacccccagggcctcatctacacagtggaacacccccagagcttcctctccctcacgaagcacccaactggataaccccagaacctcttctacccagcaggacaacccccaaacttcttttcctacttgtactccccagcgggaaaaccccaggacaccctgtgtccagcaggacgatcccagagcctcctctcccaacagaaccactcaacgagagaattccagaacatcctgtgcccagcgggacaatcccaaagcctccagaacctcctctcccaatagagccacacgagacaaccccagaacatcctgcgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgtgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgcgcccagcgggacaatcccagagcctcctctcccaatagagctgcacgagacaaccccacaacatcctgtgcccagcgggacaatcccagagcctccagaacctcctctcccaatagagccacacgagacaaccccagaacatcctgtgcccagcgggacaatcccagagcctcctctcccaatagagctacacgagacaaccccacaacatcctgtgcccagcgggacaatcccagagcctccagaacctcctctcccaatagagccacacgagataaccccagaacatcctgtgcccagcgggacaatcccagagcctcctctcccaacagaaccacccaacaagacagccccagaacatcctgtgcccgacgggacgatcccagagcctcctctcctaacagaaccatccaacaagagaaccccagaacatcctgtgccctacgggacaatcccagagcctcctctcccagcagaaccatccaacaagagaaccccagaacatcctgtgcccaacgggacgatcccagagcctcctctcctaacagaaccacccaacaagagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacgagacaaccccagaacatcctgtgcccagcgggacaatctcagagcctcctctcccatcagagccacccaacaggacaaccccagaacttgtattcaacagaacatccccagatcatcttctacccaacaagacaaccctaaaacctcttgtaccaaacgagataacctcagacccacttgtacacagcgggaccgcacacagtccttttcctttcaacgagacaaccctggaacctcctcatctcaatgctgcacccaaaaggagaatctgagaccatcatctccccaccgctccactcaatggaacaatcccaggaattcatctccccatcgtactaacaaagacatcccctgggcctcgtttcccctccggccaactcagagtgatggtccccgaacctcttccccatctcgctccaagcaaagcgaggttccctgggcatccatcgccctccggccaacccaaggtgacaggcctcagacatcctctcccagcaggccagcccagcatgacccaccccagtcctcctttggccccacccagtacaacttgccatcccgggccacctcttcctcccataacccaggccaccagagcacctcccgaacttcctcacctgtgtaccccgctgcctatggggctcccctgacctctcctgagccctcccagcctccatgtgctgtgtgcattgggcaccgggatgcccctcgagcctcttcgccccctcgctatttgcagcacgaccccttccccttcttcccagagccccgcgcccctgagagtgaaccgccccaccacgagcctccctatataccacctgctgtgtgcattggacaccgagatgccccccgggcgtcctcgcccccccgccacacccaatttgaccccttccccttcctcccagacacatcagatgccgagcatcagtgtcagtccccccaacacgagccccttcagctccctgcacctgtgtgtattgggtaccgagatgcaccccgggcctcctccccaccacgccaggccccagagccttccctcttattccaggacctccccagggccagcacagagagccttgtcccttccatggactctctgcacgagtgcccccacatccccacccctgtgtgcattgggcaccgggatgcaccctccttctcatccccaccacgccaggctcctgagccatccctcttcttccaggatccccctggaactagtatggagagcctggccccctccactgactctctgcatggctccccagtgctgatcccccaagtgtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcccccacccaggaggctggcccagagacagccagggccccaggcgcagtgcagcagcgggggccgcacccacagccctggccgtgcagaggtggagcgcctcttcgggcaagagcgcaggaagtccgaggcagcgggggccttccaggcccaggacgagggacggtcacagcagcccagccaaggccagagccaacttctccgaagacagtccagccctgcccccagcaggcaggtgaccatgctccctgccaaacaggcagaactgacccggcggagccaagcagagccccctcatccttggagtcctgagaagagacctgagggagatcggcagctccaggggtccccgctgccccccaggacatcagccaggacccctgagagggagctgcggacacagagacctctggagagtggccaagcaggcccaagacagcctctgggggtgtggcagagtcaggaggaaccgccagggtcccagggccctcatagacacctagaaaggagctggagcagccaggagggaggcctgggccctgggggctggtggggatgtggagagcccagcctgggggcagccaaagccccggagggagcatgggggggcacttccagggagtacaaggagagctgggggcagccagaggcctgggaggagaagcccactcatgagctccccagagaactaggaaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcagttccaaccagaggagcctgaggagtcagaaccaagcagaggccaagaccccctgactgaccagaagcaggcagactcggcagacaagaggccagcagagggcaaggctgggagcccgctcaagggccgactggtgacctcatggcggatgcccggggaccggcccacgctgttcaatccgttcctgctgtctctgggggtcctcaggtggcgaaggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccagtcctctcctgaggcttttcccagaggtcatgcccagccctgggcaggggtgagggcagggttgtggctgccaggcacaggtccagcgggctgggagtcctcaccatggctggctgtgctgattatggttgcatggggctgggaagaggtcccatttctgagccacagaaacaggccacatccagtaggggtcctggaaggctgtgagaacccagaggagaccctgacccagcctgcaggtagaagactgcctttggaggcagctttgaaagatgactcttccagatggaagaatcaggaagggccttcccacgtggaggcaccagcaggagcaaacgtccctggtgtgttcaggcaaagagccacaggagagtgacctcgtggagtgggaagagattgtttcccattcccttgccagggattggttgaggaatggacaaggcttgcagttcacgcaagccagtgaaatgcgaggggaagtcttgggagtggggtggaggaggtcatctgggaagggtgtccttggtcttaaaaagaggcacaagaggccgggcgcggtggctcttgcctattatcctagcactttgggaggccaaggcagggggatcacttgaggtcaggagttcgagaccagcctggccaacatggtgaaaccccgtctctactaaaaatacaaaaaattagccagacgtggtgccaagcacctgtaatcccagctactcaggaggctgaggcaggagaatcacttgaacccaggaggcagaagttgcagtgagccaagatcgcgccactgcactccagcctgtgtgacaagggcgaaactccatctcaaaaaaaaagggggagggtggcgcaaggagaggacacctctctcctggccctgtcgccatcttccctcatcaatagctaaaaatggcaaagaagaaagagccaggaccccgtgccatcaaatcctccggccttgtgctgccctgtctcggcactgcttgccttaggagatcaggagtgttcctagccactgggagatgggatgcctgccactggcagctctgccgtccatcctcaccatcccaccgtccccccaagacagctctccatcccatcctctgcctcccttctagcctcaacctaactcagggctcccccgtctcacacctgggttgcaggaacatcctcttcaccaacccccctcccatccctcctcagggctgcctagggcagctacaaaaaccaggccagcctctgaaaggtgctccacatctcattaaaaaccgtgaaatcgcactgccccactatcagaatagctcagaggagaaggtctgccagtaccaagtgctggtggggatacggagaagagcagctcccaggcgctgctggtgcaaatgtgctttgttgcacccacggcaggaaactgaccagcttctcatcaagttaaatacgcatctaccctatggcctagcatttccactcttgcttacacatccaggagaaatgagtccttacatgcacaaaaggatgagtaccgtaatactcacatcagcaaataaacaatacagctgtgtgtcagtagtagaatgaataaattgtggtcgattcata

SEQ ID NO: 194656 - DNA, 2324 bp, Homo sapiens
  Payload ID: 18468
  Gene Name: TRIO and F-actin binding protein
  Uniprot ID: Q9H2D6
  ENST ID: ENST00000403663
  CDS Start-End: 6-1964
gttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaa

SEQ ID NO: 194657 - DNA, 919 bp, Homo sapiens
  Payload ID: 18468
  Gene Name: TRIO and F-actin binding protein
  ENST ID: ENST00000417857
  CDS Start-End: 150-919
gctggtctggactgccctctgagctctcagggggtctctatgcaggcagagtcctcccagcccctctctcccattcttgggcgaggggtcggctggagagaggcccctgggacatctggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaa

SEQ ID NO: 194658 - DNA, 939 bp, Homo sapiens
  Payload ID: 18468
  Gene Name: TRIO and F-actin binding protein
  ENST ID: ENST00000418339
  CDS Start-End: 145-939
cttagatgagagaggtctccccagcaggaagggagggtctggtggttggcacccactagatgagcatggtcagaaaaatatcaggatgagcaacttctttatctaggcctgggtgggggtgcctggcacaggtctccatgggacatgctgcagctggtagcccccagaccccggggctgtgcccccctgggcggcacccagaagcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaa

SEQ ID NO: 194659 - DNA, 931 bp, Homo sapiens
  Payload ID: 18468
  Gene Name: TRIO and F-actin binding protein
  ENST ID: ENST00000428075
  CDS Start-End: 1-931
gggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaag

SEQ ID NO: 194660 - DNA, 904 bp, Homo sapiens
  Payload ID: 18468
  Gene Name: TRIO and F-actin binding protein
  ENST ID: ENST00000413051
  CDS Start-End: 1-309
ggcggcggcggcggggttcccgcgccgcggagcccggcccgagagccgcgtccacgttcctgcctcctgctcccgccgccctggggcgccgccatgacggtatacagggaggggctgggatgccaacctactgggtcccccgactgtggctgtggaaggttctggatcttcagctgtcccaagccccgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccc

SEQ ID NO: 194661 - DNA, 586 bp, Homo sapiens
  Payload ID: 18468
  Gene Name: TRIO and F-actin binding protein
  ENST ID: ENST00000452519
  CDS Start-End: 337-586
ttcgcgcagtgctgctggtctggactgccctctgagctctcagggggtctctatgcaggcagagtcctcccagcccctctctcccattcttgggcgaggggtcggctggagagaggcccctgggacatctgggtgtgtgtgccagccacccagcccaacttcttggctctctgagtgccactatcaggaaaggggccagggctgcctcagtggctgggaggcctgcttggacttgggggttacctagggccttagccctcttggctggcttcccaggagctcggtcccacaggacttggggacaggcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgt

SEQ ID NO: 194662 - DNA, 4065 bp, Homo sapiens
  Payload ID: 18469
  Gene Name: trio Rho guanine nucleotide exchange factor
  Uniprot ID: O75962
  ENST ID: ENST00000344135
  CDS Start-End: 494-2284
tgttcgtgtcttctaataagagcaagccgatcattaaccttctcaacgcagcgtcttttggtttcttccatttccaaccagcagaatatcttcttggaactttcttttttaacctctgccttcctcacgcacctattttttggagggttccttttccctgctctctacctcctgtttaaattgaaacctgtacactttaagctttttgctcatcgcttggttttgctcttttatgccttaaattatctttgcggcatttttgactcatctgctggggaagaccattccctcaagaaaacttccaacagcaactcaaagcaaactaagatgaaaaaatggggggaaagaatctgtccactgggaacgctttacgtcaccgtgttgctctggaagacagagactgctctgggcacctggcgaggcggctctgcagtgcaggctggggccggtccctgcggcctgctgggctctggcctcgtttggcccatcactcatgctgccgtctcaagcacaagggttgctgtggtgggttttccctctgtttcctgcttcctcactgtcctacccacctgtttcctacagggcagatggcctggcccgtaacactttcctgaaggcatgcagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctg

SEQ ID NO: 194663 - DNA, 11100 bp, Homo sapiens
  Payload ID: 18469
  Gene Name: trio Rho guanine nucleotide exchange factor
  Uniprot ID: O75962
  ENST ID: ENST00000344204
  CDS Start-End: 25-9318
gcggccgcgggcgccgccgcagccatgagcggcagcagcggcggagccgccgcccccgccgcgtcctccggccccgccgcggcggccagcgcggctggctcgggctgcgggggcggtgccggcgagggggcagaggaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctgcaaaaaaataaaaagataacttttttaaacaaacatgaatagaattttgcaaatttaacgttttcaagatttattcaaggaaacaaaatgcctatgttcaaccactggtgttaatgaacaaagatactgtgcgtctctggggaagacgcacctaggtggcggccactcccatggccttgtctaggactcagagaccactcggctctgagcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctga

SEQ ID NO: 194664 - DNA, 8907 bp, Homo sapiens
  Payload ID: 18469
  Gene Name: trio Rho guanine nucleotide exchange factor
  ENST ID: ENST00000512070
  CDS Start-End: 67-6996
gaggcggccaaggacctggccgacatcgcggccttcttccgatccgggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcagagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcaggggcagattctctgtcgttaagaaatgtgatcagaaaggaaccaagcgagcagtggccactaagtttgtgaacaagaagttgatgaagcgcgaccaggtcacccatgagcttggcatcctgcagagcctccagcaccccctgcttgtcggcctcctcgacacctttgagacccccaccagctacatcctggtcttagaaatggctgaccagggtcgcctcctggactgcgtggtgcgatggggaagcctcactgaagggaagatcagggcgcacctgggggaggttctggaagctgtccggtacctgcacaactgcaggatagcacacctggacctaaagcctgagaatatcctggtggatgagagtttagccaagccaaccatcaaactggctgactttggagatgctgttcagctcaacacgacctactacatccaccagttactggggaaccctgaattcgcagcccctgaaatcatcctcgggaaccctgtctccctgacctcggatacgtggagtgttggagtgctcacatacgtacttcttagtggcgtgtcccccttcctggatgacagtgtggaagagacctgcctgaacatttgccgcttagactttagcttcccagatgactactttaaaggagtgagccagaaggccaaggagttcgtgtgcttcctcctgcaggaggaccccgccaagcgtccctcggctgcgctggccctccaggagcagtggctgcaggccggcaacggcagaagcacgggcgtcctcgacacgtccagactgacttccttcattgagcggcgcaaacaccagaatgatgttcgacctatccgtagcattaaaaactttctgcagagcaggcttctgcctagagtttgacctatccagaagttctttctcattctctttcacctgccaatcagctgttaatctgaattttcaagagaaaacaagcaaacataactgatcagctgccggtatgttcatcgtgtgaaattgcattccaagtgagctgtgctcagcagtgcttggacacagagctgcaagctgcgctggggtggaggaccgtcacttacactctgcccaaggcagaggtcgcattgctgtatcacagtattttattcaggtttctg

SEQ ID NO: 194665 - DNA, 7995 bp, Homo sapiens
  Payload ID: 18469
  Gene Name: trio Rho guanine nucleotide exchange factor
  ENST ID: ENST00000513206
  CDS Start-End: 1-7641
attaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttacctcagagttgggtgtcacagaacatgttgaaggagacccttgcaaatttgcactgtgggtggggagaacaccaacttcagataataaaattgtccttaaggcttccagcatagagaacaagcaggactggataaagcatatccgcgaagtcatccaggagcggacgatccacctgaagggagccctgaaggagcccattcacatccctaagaccgctcccgccacaagacagaagggaaggagggatggagaggatctggacagccaaggagacggcagcagccagcctgatacgatttccatcgcctcacggacgtctcagaacacgctggacagcgataagctctctggtggctgtgagctgacagtggtgatccatgacttcaccgcttgcaacagcaacgagctgaccatccgacggggccagaccgtggaagttctggagcggccgcatgacaagcctgactggtgtctggtgcggacaactgaccgctccccagcggcagaaggcctggtcccctgtggttcactgtgcatcgcccactccagaagtagcatggaaatggagggcatcttcaaccacaaagactcgctctccgtctccagcaatgacgccagtccacccgcatccgtggcttccctccagccccacatgatcggggcccagagctcgccgggccccaagcggccgggcaacaccctgcgcaagtggctcaccagccccgtgcggcggctcagcagcggcaaggccgacgggcacgtgaagaagctggcgcacaagcacaagaagagccgcgaggtccgcaagagcgccgacgccggctcgcagaaggactccgacgacagtgcggccaccccgcaggacgagacggtcgaggagagaggccggaacgagggcctgagcagcggtactctctccaaatcctcctcctcggggatgcagagctgtggagaagaggaaggcgaggagggggccgacgccgtgcccctgccgccacccatggccatccagcagcacagcctcctccagccagactcacaggatgacaaggcctcttctcggttattagtccgccccaccagctccgaaacaccgagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacgggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatgaaatcaaccaaattttagaaaaccagcgcaattttttaaatgccttgacatcgccaatcgagtaccagaggaaccacagcgggggcggcggcggcggcggcagcgggggcagcggcgggggtgggggcagcggcggcggcggggcccccagtggcggcagcggccacagtggcggccccagcagctgcggcggcgcccccagcacgagcaggagccggccctcccggatcccccagcctgtccgacaccacccccccgtgctggtctcctctgcagcctcgagccaggcagaggcagacaagatgtcaggtacgtccacccccgggccctccctgcctccccctggcgcggcccccgaggccggccccagcgcgcccagcaggcggccccccggcgcggacgccgaggggtccgagcgagaagcggagccgatccccaagatgaaggtgctggagagccccaggaaaggcgccgcgaacgcctcggggtcgagcccagacgcccccgccaaggacgcgcgcgctagcctgggcaccctgccgcttgggaagccccgggccggggccgcttcgccgctgaactcgccgctctccagcgcggtcccttctctcggcaaggagcccttcccccccagcagccccctgcagaaggggggctccttctggagctccatccccgcctcccccgccagccgacccggctccttcaccttcccgggggacagcgactccctccagcggcagacaccccgccacgcggcccctggcaaggatactgaccgcatgagcacgtgctcctcggccagcgagcagtccgtgcagtccacccagagcaacgggagtgaaagcagcagcagtagcaacatctccaccatgttggtgacacacgattacacggcagtgaaggaggatgagatcaacgtctaccaaggagaggtcgttcaaattctggccagcaaccagcagaacatgtttctggtgttccgagccgccactgaccagtgccccgcagctgagggctggattccaggctttgtcctgggccacaccagtgcagtcatcgtggagaacccggacgggactctcaagaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaagcttctcaatcccaactacatttatgacgttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacagtgacctgggagaggccacgctgaagattgtgggcgtgaccacggaagatgacggcatctacacgtgcatcgctgtcaatgacatgggttcagcctcatcgtcggccagcctgagggtcctaggtccagggatggatgggatcatggtgacctggaaagacaactttgactccttctacagtgaagtggctgagcttggcagggcaaactggaacaactggtcaccctactaacctgtaaactgggaataactggcatttgtgcagaatggctcccaggttcctgatgcccagcggcactctacagacattgccaggtctgtctgcaaatccacggtgcttggccggatgctgtttgaagtgtgcactttagagaagaaaaggggcggggtgtcatttcccacacacaagccgctagtccttatggaaactcttccaacgaaggtggatggaaacttttccaacgaaggtgatgtttttgaaacccagcttttatttggacaaagccttcttgaaaaatccttgaaaatgctttctgtttttaataaaggagatctctggaacatttccatgagctttcatagcact

SEQ ID NO: 194666 - DNA, 4949 bp, Homo sapiens
  Payload ID: 18469
  Gene Name: trio Rho guanine nucleotide exchange factor
  ENST ID: ENST00000509967
  CDS Start-End: 153-4679
atttgggatatctagaggttgtttgttggtgttctgggatcctgagggacactgccaactgttaacctttggcagatagtgactgttttacttcgattttattttcgtggtaaccgttttttaaaaaagattaataaattacccaagaggacatggcagaagggtttcgaaaaaacgatgaaatgaaagctatggatgttttaccaattttgaaggaaaaagttgcatacctttcaggtgggagagataaacgtggaggtcccattttaacgtttccggcccgcagcaatcatgacagaatacgacaggaggatctcaggagactcatttcctatctagcctgtattcccagcgaggaggtctgcaagcgtggcttcacggtgatcgtggacatgcgtgggtccaagtgggactccatcaagccccttctgaagatcctgcaggagtccttcccctgctgcatccatgtggccctgatcatcaagccagacaacttctggcagaaacagaggactaattttggcagttctaaatttgaatttgagacaaatatggtctctttagaaggccttaccaaagtagttgatccttctcagctaactcctgagtttgatggctgcctggaatacaaccacgaagaatggattgaaatcagagttgcttttgaagactacattagcaatgccacccacatgctgtctcggctggaggaacttcaggacatcctagctaagaaggagctgcctcaggatttagagggggctcggaatatgatcgaggaacattctcagctgaagaagaaggtgattaaggcccccatcgaggacctggatttggagggacagaagctgcttcagaggatacagagcagtgaaagctttcccaaaaagaactcaggctcaggcaatgcggacctgcagaacctcttgcccaaggtgtccaccatgctggaccggctgcactcgacacggcagcatctgcaccagatgtggcatgtgaggaagctgaagctggaccagtgcttccagctgaggctgtttgaacaggatgctgagaagatgtttgactggatcacacacaacaaaggcctgtttctaaacagctacacagagattgggaccagccaccctcatgccatggagcttcagacgcagcacaatcactttgccatgaactgtatgaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaagtatatgagcaacgtggattcatggtgtaaagcttgcggtgaggtagaccttccctcagagctgcaggacctagaagatgccattcatcaccaccagggaatatatgaacatatcactcttgcttattctgaggtcagccaagatgggaagtcgctccttgacaagctccagcggcccttgactcccggcagctccgattccctgacagcctctgccaactactccaaggccgtgcaccatgtcctggatgtcatccacgaggtgctgcaccaccagcggcagctggagaacatctggcaacaccgcaaggtccggctgcatcagaggctgcagctgtgtgttttccagcaggacgttcagcaggtgctagactggatcgagaaccacggagaagcatttctgagcaaacatacaggtgtggggaaatctcttcatcgggccagagcattgcagaaacgtcatgaagattttgaagaagtggcacagaacacatacaccaatgcggataaattactggaagcagcagaacagctggctcagactggggaatgtgaccccgaagagatttatcaggctgcccatcagctggaagaccggattcaagatttcgttcggcgtgttgagcagcgaaagatcctactggacatgtcagtgtcctttcacacccatgtgaaagagctgtggacgtggctggaggagctgcagaaggagctgctggacgacgtgtatgccgagtcggtggaggccgtgcaggacctcatcaagcgctttggccagcagcagcagaccaccctgcaggtgactgtcaacgtgatcaaggaaggggaggacctcatccagcagctcagggactctgccatctccagtaacaagaccccccacaacagctccatcaaccacattgagacggtgctgcagcagctggacgaggcgcagtcgcagatggaggagctcttccaggagcgcaagatcaagctggagctcttcctgcagctgcgcatcttcgagagggacgccatcgacattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtgtggagctgctgtgtgatagagatgtagacatggcaactcgggtccaggacctgctggagtttcttcatgaaaaacagcaggaattggatttagccgcagagcagcatcggaaacacctggagcagtgcgtgcagctgcgccacctgcaggcagaagtgaaacaggtgctgggttggatccgcaacggagagtccatgttaaatgccggacttatcacagccagctcgttacaagaggcagagcagctccagcgagagcacgagcagttccagcatgccattgagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtctgcagcgtcctcgagagcctggaacaggagtacaagagagaagaagactggtgtggcggggcggataagctgggcccaaactctgagacggaccacgtgacgcccatgatcagcaagcacctggagcagaaggaggcattcctgaaggcttgcacccttgctcggaggaatgcagacgtcttcctgaaatacctgcacaggaacagcgtgaacatgccaggaatggtgacgcacatcaaagctcctgaacagcaagtgaaaaatatcttgaatgaactcttccaacgggagaacagggtattgcattactggaccatgaggaagagacggctggaccagtgtcagcagtacgtggtctttgagaggagtgccaagcaggctttggaatggatccatgacaatggcgagttctacctttccacacacacctccacgggctccagtatacagcacacccaggagctcctgaaagagcacgaggagttccagataactgcaaagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcgagtaaaagtctccagctagatatcattccagccagtatccctggctcagaggtgaaacttcgagatgctgctcatgaacttaatgaagagaagcggaaatctgcccgcaggaaagagttcataatggctgagctcattcaaactgaaaaggcttatgtaagagacctccgggaatgtatggatacgtacctgtgggaaatgaccagtggcgtggaagagattccacctggcattgtaaacaaagaactcatcatcttcggaaacatgcaagaaatctacgaatttcataataacatattcctaaaggagctggaaaaatatgaacagttgccagaggatgttggacattgttttgttacttgggcagacaagtttcagatgtatgtcacatattgcaaaaataagcctgattctactcagctgatattggaacatgcagggtcctattttgacgagatacagcagcgacatggattagccaattccatttcttcctaccttattaaaccagttcagcgaataacgaagtatcagctccttttaaaagagctgctgacgtgctgtgaggaaggaaagggagagattaaagatggcctggaggtgatgctcagcgtgccgaagcgagccaatgatgccatgcacctcagcatgctggaagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttgtaagtataggcgttcagaattgtaagtctaaaggtaacacaattgcagtctttttgtaggtagagaagaattgttcattgtcttcagtttaacctcccaatctgtcctgaaatgttcaagtctgaattgtggtagggttttcatcttcagtgaaattatttcccaccctcaagtccactagagggtgctctggagtttatagacttaggaaacttgctcttcttaaatcctgtatcatataactgcaggataagaaaacatttcataagtgaaatcatttatctccggtgtgcttaactagctttataaataaaataatcatatctatg

SEQ ID NO: 194667 - DNA, 1547 bp, Homo sapiens
  Payload ID: 18469
  Gene Name: trio Rho guanine nucleotide exchange factor
  ENST ID: ENST00000620511
  CDS Start-End: 50-817
gagtgcagccgagctcgtcagtgcaattgaggaactcgtgaaaagcaagatggcactggaggatcgccccagctcactccttgttgaccagggagatagtagcagcccttccttcaacccttcggataattcccttctctcttcctcctcgcccattgatgagatggaagaaaggaaatccagctctttaaagagaagacactacgttttgcaagaactagtggagacagagcgtgactatgtgcgggaccttggctatgtggttgagggctacatggcacttatgaaagaagatggtgttcctgatgacatgaaaggaaaagacaaaattgtgttcggcaacatccatcagatttacgactggcacagagacttttttttaggagagttagagaagtgccttgaagatccagaaaaactaggatccctttttgttaaacacgagagaaggttgcacatgtacatagcttattgtcaaaataaaccaaagtctgagcacattgtctcagaatacattgataccttttttgaggacttaaagcagcgtcttggccacaggttacagctcacagatctgttgatcaaaccagtgcagagaatcatgaagtatcagctgttactgaaggacttcctcaagtattccaaaaaggccagcctggatacatcagaattagagagagctgtggaagtcatgtgcatagtacccaggcggtgcaacgacatgatgaacgtggggcggctgcaaggattcgacggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcc

SEQ ID NO: 194668 - DNA, 4696 bp, Homo sapiens
  Payload ID: 18470
  Gene Name: triokinase/FMN cyclase
  Uniprot ID: Q3LXA3
  ENST ID: ENST00000394900
  CDS Start-End: 230-1957
accgcctcgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgtcctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttcttagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaaaaaaaaaaaaaaaaaagaaactgcagccaagccagcccctaggtctctttctagagcgatcactgatggcaccagggtgagcaggggcactgtatgcatgtggagacaaacagcacatgcctggcacacatgtagggtagggagtggttaaaggcactggctgtcgactcatacacatgatctgaaatctgattctgctttaacccggctacaggagctaaggcctattttttagccctttgggatctgtaaaatcagaatggtacccacctcatggggacatgaaaggattcaaatgaattgatgaagatgggccataaagcccagcacagtccaagtgctcactcactgagagttacggttatcacaggggttgggcccccagcccctcccaggtcatctgctctaccactagctggtaggaaagagcctcctgccctcccaacccccgtcacctacttggcccaaatttggctgcaggctccccgagtgcctgggcttctctacccagggtcctgtctgtcggctgcaccatacgtccctgaccacaaggcatccacgtgcacaggagtatgcgcccagcagctgggaaggaggctgacctcagacggtggcctgtggatcccagctctgtcatttcctggctgggtgacctcaacctagtcaccctttttgagtcttgttttctcagattatgaaataggaaaaatttccttcctcgtgagataagcacgtgccattagctattaaggacacgcacataaatgagctgcatgtgaatccacacatgccattccatgaagacagaggatcatgtggatctttggtgccttccggttggcccctccctaggtctgtgagggtcagacctgtcctgaggcttttacaaattggcccagaactcatttaaccacagcatcatttcattagagggctgttattagagactgaatgtttgtgtcccccccaaattcctgtgttgaaaggctcacccccactatggtagtgttaggacgtggggcctttgggaggtgatggggttatgagggtggagccccagagagctctcacgccctttccaccatgtgaggttatggtgagaagatggtctctgaggaagctggcccttgccacacaccacatttgccagcgccttcatcttggatgtctatagcctccagaactgtgagaaataaacacttgttgtttaagccacccaggctattatatttttgttatagcagcctgaacaaagacagctttgattcttaacatatttaatgaaactcgagcttcataaaccagtgaaatgcctacccctatggagatggggagctggtcatgggacccaggtgcctggaggacatcccagtggctttgaaggctccagccagtcaagacggtcaatattagcccttctgccaacatctggcaatgtgaggctggggtggacgttggcctgatgttgccaggagtaggatgctgatgctgccagagagtaggtgggctccaaaccccaggcttctcacttgcttactaagcacagcagtctgaagcttgggacctggcagtgcgtctttggagaaggcaaaaaagccacagcagcaacacttaggagcaagacccttcccgctctccaccctatttcctcccctgaagaagagcaacagctcaagctctagcatggcacagaacgct

SEQ ID NO: 194669 - DNA, 805 bp, Homo sapiens
  Payload ID: 18470
  Gene Name: triokinase/FMN cyclase
  ENST ID: ENST00000532173
  CDS Start-End: 320-805
ctttccgccagcgcccgcaggacccggatgagagcgcacgcttcggggtctccgggaagtcgcggcgccttcggatgtggcggatgcggccgtgagccggcgggggagttcctccagatccagctggtgccctcgcctgacgtttgaacgaccacctgctcacctcctcccttttgcgcgttgattcttcagacttcaaagggcccaccggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaag

SEQ ID NO: 194670 - DNA, 1781 bp, Homo sapiens
  Payload ID: 18470
  Gene Name: triokinase/FMN cyclase
  ENST ID: ENST00000529479
  CDS Start-End: 1-1602
acctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgtcctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaaggaaggaggcggcctggtgatctgcccttgaacctgctcccacaccccatcccccagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctag

SEQ ID NO: 194671 - DNA, 558 bp, Homo sapiens
  Payload ID: 18470
  Gene Name: triokinase/FMN cyclase
  ENST ID: ENST00000524968
  CDS Start-End: 388-558
attctgaggatcactgtcctttagtgatgaagtgggtgctgttcctggacataaaggcagacctgtgcttgacatggattgatctgtcttctggcagtgaagtgcaggcatgaaccttggtcagccccacactcttctccatccgtagcccatgtactagagtttggacttggaccgaagtctggggcagctccctaattactagggtgctgaaggcgtgattgtgccagtcgactgcgagttccttccgcagcttgtatcgttacccactcctgcaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctct

SEQ ID NO: 194672 - DNA, 964 bp, Homo sapiens
  Payload ID: 18470
  Gene Name: triokinase/FMN cyclase
  ENST ID: ENST00000534084
  CDS Start-End: 1-660
agccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgtcctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagatcaggagtggacccaaccccaaaatctctcctcccttgggtgagtcctgtgatcacagggtgtatcttttgaagaccctattccctcctcttcaccttagagttggggaccccactgcactcacaaactgaagaaaagcttctcattaatgcccgaaatgacggatgcgatggacagagagaggatggcggctccaaaaaagacgtggataggttttaggaggctgcgcagccacatggacgcccagggcaggaggaagacagcaaagcccaggaaccactgtggacaaaagggaggacacacccgactgtgctatgtgtgaccaaagcacatcccaccccatcagtgcctcctccccatctctgctccctggctcttctttcacaactcaaaccttcccacctggcattgcccactaccgtgctagcttcctca

SEQ ID NO: 194673 - DNA, 4059 bp, Homo sapiens
  Payload ID: 18470
  Gene Name: triokinase/FMN cyclase
  ENST ID: ENST00000617083
  CDS Start-End: 74-1804
accacagcagtgtggctgcgcaggatgggggtatctgtactgaccacattctgacctccttctcactcctcccttgcagacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgtcctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttcttagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaaaaaaaaaaaaaaaaaagaaactgcagccaagccagcccctaggtctctttctagagcgatcactgatggcaccagggtgagcaggggcactgtatgcatgtggagacaaacagcacatgcctggcacacatgtagggtagggagtggttaaaggcactggctgtcgactcatacacatgatctgaaatctgattctgctttaacccggctacaggagctaaggcctattttttagccctttgggatctgtaaaatcagaatggtacccacctcatggggacatgaaaggattcaaatgaattgatgaagatgggccataaagcccagcacagtccaagtgctcactcactgagagttacggttatcacaggggttgggcccccagcccctcccaggtcatctgctctaccactagctggtaggaaagagcctcctgccctcccaacccccgtcacctacttggcccaaatttggctgcaggctccccgagtgcctgggcttctctacccagggtcctgtctgtcggctgcaccatacgtccctgaccacaaggcatccacgtgcacaggagtatgcgcccagcagctgggaaggaggctgacctcagacggtggcctgtggatcccagctctgtcatttcctggctgggtgacctcaacctagtcaccctttttgagtcttgttttctcagattatgaaataggaaaaatttccttcctcgtgagataagcacgtgccattagctattaaggacacgcacataaatgagctgcatgtgaatccacacatgccattccatgaagacagaggatcatgtggatctttggtgccttccggttggcccctccctaggtctgtgagggtcagacctgtcctgaggcttttacaaattggcccagaactcatttaaccacagcatcatttcattagagggctgttattagagactgaatgtttgtgtcccccccaaattcctgtgttgaaaggctcacccccactatggtagtgttaggacgtggggcctttgggaggtgatggggttatgagggtggagccccagagagctctcacgccctttccaccatgtgaggttatggtgagaagatggtctctgaggaagctggcccttgccacacaccacatttgccagcgccttcatcttggatgtctatagcctccagaactgtgagaaataaacacttgttgtttaagcc

SEQ ID NO: 194674 - DNA, 1763 bp, Homo sapiens
  Payload ID: 18471
  Gene Name: triosephosphate isomerase 1
  Uniprot ID: P60174
  ENST ID: ENST00000229270
  CDS Start-End: 338-1198
ggaggttgtctatcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaaca

SEQ ID NO: 194675 - DNA, 1231 bp, Homo sapiens
  Payload ID: 18471
  Gene Name: triosephosphate isomerase 1
  Uniprot ID: P60174
  ENST ID: ENST00000396705
  CDS Start-End: 37-786
gcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactagg

SEQ ID NO: 194676 - DNA, 1587 bp, Homo sapiens
  Payload ID: 18471
  Gene Name: triosephosphate isomerase 1
  Uniprot ID: P60174
  ENST ID: ENST00000535434
  CDS Start-End: 528-1031
ctcgccggcgtccgcgtccccgcgccgagctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttct

SEQ ID NO: 194677 - DNA, 374 bp, Homo sapiens
  Payload ID: 18471
  Gene Name: triosephosphate isomerase 1
  ENST ID: ENST00000462761
  CDS Start-End: 259-374
gactcccgccttccacggaagggaccgagcccgtgccaaacaggctgagcgatttgggagtgaggagccatcctaccgctttccccaacctggaaacagcaaagcgcaaggcctctgagtcagttagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagaggg

SEQ ID NO: 194678 - DNA, 839 bp, Homo sapiens
  Payload ID: 18471
  Gene Name: triosephosphate isomerase 1
  ENST ID: ENST00000493987
  CDS Start-End: 501-839
agctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtcc

SEQ ID NO: 194679 - DNA, 791 bp, Homo sapiens
  Payload ID: 18471
  Gene Name: triosephosphate isomerase 1
  Uniprot ID: P60174
  ENST ID: ENST00000488464
  CDS Start-End: 288-791
gactcctccccttcctcgccggcgtccgcgtccccgcgccgagctgctcgggctccctgagccccagatctgaccccttcccttcggcaacctgaacgactcccgccttccacggaagggaccgagcccgtgccaaacaggctgagcgatttgggaaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatga

SEQ ID NO: 194680 - DNA, 820 bp, Homo sapiens
  Payload ID: 18471
  Gene Name: triosephosphate isomerase 1
  ENST ID: ENST00000495834
  CDS Start-End: 527-820
ccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcagagggcagggtgagggccgtggcctctcaggggtatctggaaggctcttcgagttgagtgcagacccagcctgggctggaaaatggacaaaggtcatcttgctggggtgaaaagggggagagcagaaccaagaagaagagggtgagggctggggggctccagggcactggttaggaattgtggggaatgaaggctttctttagtctcatccccctgtggtaccatcttgtcctcagaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaa

SEQ ID NO: 194681 - DNA, 1460 bp, Homo sapiens
  Payload ID: 18471
  Gene Name: triosephosphate isomerase 1
  Uniprot ID: P60174
  ENST ID: ENST00000613953
  CDS Start-End: 37-897
gggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctggggcactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctggcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaa

SEQ ID NO: 194682 - DNA, 3007 bp, Homo sapiens
  Payload ID: 18472
  Gene Name: tripartite motif containing 10
  Uniprot ID: Q9UDY6
  ENST ID: ENST00000259941
  CDS Start-End: 77-1264
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194683 - DNA, 3546 bp, Homo sapiens
  Payload ID: 18472
  Gene Name: tripartite motif containing 10
  Uniprot ID: Q9UDY6
  ENST ID: ENST00000354038
  CDS Start-End: 77-1522
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194684 - DNA, 3007 bp, Homo sapiens
  Payload ID: 18472
  Gene Name: tripartite motif containing 10
  Uniprot ID: Q9UDY6
  ENST ID: ENST00000376704
  CDS Start-End: 77-1264
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194685 - DNA, 3546 bp, Homo sapiens
  Payload ID: 18472
  Gene Name: tripartite motif containing 10
  Uniprot ID: Q9UDY6
  ENST ID: ENST00000449208
  CDS Start-End: 77-1522
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaatagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194686 - DNA, 3546 bp, Homo sapiens
  Payload ID: 18472
  Gene Name: tripartite motif containing 10
  Uniprot ID: Q9UDY6
  ENST ID: ENST00000451727
  CDS Start-End: 77-1522
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194687 - DNA, 3007 bp, Homo sapiens
  Payload ID: 18472
  Gene Name: tripartite motif containing 10
  Uniprot ID: Q9UDY6
  ENST ID: ENST00000417411
  CDS Start-End: 77-1264
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194688 - DNA, 3007 bp, Homo sapiens
  Payload ID: 18472
  Gene Name: tripartite motif containing 10
  Uniprot ID: Q9UDY6
  ENST ID: ENST00000413055
  CDS Start-End: 77-1264
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaatagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194689 - DNA, 3007 bp, Homo sapiens; identical to SEQ ID NO: 194688
  Payload ID: 18472
  Gene Name: tripartite motif containing 10
  Uniprot ID: Q9UDY6
  ENST ID: ENST00000447465
  CDS Start-End: 77-1264

SEQ ID NO: 194690 - DNA, 3546 bp, Homo sapiens; identical to SEQ ID NO: 194685
  Payload ID: 18472
  Gene Name: tripartite motif containing 10
  Uniprot ID: Q9UDY6
  ENST ID: ENST00000431258
  CDS Start-End: 77-1522

SEQ ID NO: 194691 - DNA, 3546 bp, Homo sapiens
  Payload ID: 18472
  Gene Name: tripartite motif containing 10
  Uniprot ID: Q9UDY6
  ENST ID: ENST00000449742
  CDS Start-End: 77-1522
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194692 - DNA, 3546 bp, Homo sapiens; identical to SEQ ID NO: 194685
  Payload ID: 18472
  Gene Name: tripartite motif containing 10
  Uniprot ID: Q9UDY6
  ENST ID: ENST00000426996
  CDS Start-End: 77-1522

SEQ ID NO: 194693 - DNA, 3007 bp, Homo sapiens; identical to SEQ ID NO: 194688
  Payload ID: 18472
  Gene Name: tripartite motif containing 10
  Uniprot ID: Q9UDY6
  ENST ID: ENST00000446013
  CDS Start-End: 77-1264

SEQ ID NO: 194694 - DNA, 3549 bp, Homo sapiens
  Payload ID: 18472
  Gene Name: tripartite motif containing 10
  Uniprot ID: Q9UDY6
  ENST ID: ENST00000448645
  CDS Start-End: 77-1522
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtgagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194695 - DNA, 3009 bp, Homo sapiens
  Payload ID: 18472
  Gene Name: tripartite motif containing 10
  Uniprot ID: Q9UDY6
  ENST ID: ENST00000416714
  CDS Start-End: 76-1263
agtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194696 - DNA, 3549 bp, Homo sapiens
  Payload ID: 18472
  Gene Name: tripartite motif containing 10
  Uniprot ID: Q9UDY6
  ENST ID: ENST00000456988
  CDS Start-End: 77-1522
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194697 - DNA, 3010 bp, Homo sapiens
  Payload ID: 18472
  Gene Name: tripartite motif containing 10
  Uniprot ID: Q9UDY6
  ENST ID: ENST00000428611
  CDS Start-End: 77-1264
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatgtagagaaaaaaaaaacctgctctatatctgaaagagctcttgggaagacagagaaacataaagaggaaattatagcacagtgtggtgggtgttacgggaagtccaaccccagcattatgggagttcaggggaaggggcatagcccagcctggaaggagaggatgagtgggggatggctttctgaaaagggtagtctaaaggatgcctatagtcaatagggaaaagaggggaagaagcatcttaagaagaggaaacagcagagaactggctggatgacctgtgactctggagcactgggttgtctccattgtccttatgggcagatgtgtgccatccccagccgacaccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgacctttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagatgtaaaatacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattaaagattgaattgctttccctgggagtgtgcagtatctcattaaaatgttgtatattcaaaaaaatacagacacacacaagtgcctatataatgataaaacatatgcaaagcacccaaacctgtgattccagaaaggtagatcctatttttctgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 194698 - DNA, 2715 bp, Homo sapiens
  Payload ID: 18473
  Gene Name: tripartite motif containing 11
  Uniprot ID: Q96F44
  ENST ID: ENST00000284551
  CDS Start-End: 280-1686
cttccgcctcggctcctcttcctgccggcatccgggatccctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggcccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaa

SEQ ID NO: 194699 - DNA, 2511 bp, Homo sapiens
  Payload ID: 18473
  Gene Name: tripartite motif containing 11
  Uniprot ID: Q96F44
  ENST ID: ENST00000366699
  CDS Start-End: 240-1397
ctacgtcccgcgtcccccgagcgctcggagcctacgcgcccagcgctaccgaaacccagagtcctgcgccctggagtccccgcgccccggagcccgagcacccgggagtcccgagcctcgcgccccggagtgcccgagcctgcgccgccgcacccggataccccgcgtccccgcgagctgccgaggccgcccgccgccgccccgcggacagtaccgccttcctcccctctgtccgcgccatggccgcccccgacctgtccaccaacctccaggaggaggccacctgcgccatctgcctcgactacttcacggatccggtgatgaccgactgcggccacaacttctgccgcgagtgcatccggcgctgctggggccagcccgagggcccgtacgcgtgccccgagtgccgcgagctgtccccgcagaggaacctgcggcccaaccgcccgcttgctaagatggccgagatggcgcggcgcctgcacccgccgtcgccggtcccgcagggcgtgtgccccgcgcaccgcgagccactggccgccttctgtggcgacgagctgcgcctcctgtgtgcggcctgcgagcgctctggggagcactgggcgcaccgcgtgcggccgctgcaggacgcggccgaagacctcaaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggtaggtgtggaggccccaggtggggagatgactccaggaggggacctgccaaggacctgggcagccagccacgtgttctgtgccctgccactgccagctccaaactcacagtgtcatggtggtgggttgttgggaaaacgtcctctgctcatacttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagatgccagtcacaacttccaggggctgcccatacttctgttccctcagcgcctctgcagatgtgagcattcgctagcacagcccatggaactcagaagagcactttacttactgtcattggtttattgtgaaggataccactcaggaagagccaaatggaagagacacatgggcaaagcctggggaagggctcagagctttcccaccctccctgggtgcaccttcccagcacctcagtgtgctcaccaacctggaaactccctgagccccaagagctgtttaggtgtctttgtggaggttccattacatggttatgattgattaaatcattggtcattggtgatggggctcaacctcagacccctttccccttcctgaggtcagaggctggggctgagtgttcccgccctctactgacaggattggtctttctggtggctggccttatgctgggctctcaggtccccacctcagccactgcagtggcatcaactcaggtgtgatggaaaggggcatcttatgatagcacaagatgcttctatcagtcaggaaattcccagggttctgtgagctctgcgccaggaactgggcacaaaacccaaatctgagtcttgtatcacagtcacccaaaggaagtactatcctcagctcttgctagcaggtcaggagcctgttgtgtaggaactgtgtgcaggcctccagaggtggatagatctgaaatcggagtggtcagggttgggacagctgccctaattcacatccttcatttggagattgaaaggaaaaacagactggatgcattggctcacctctgtaatcccagcactttgagaggctcaggcgggaggattgcttgaggccatcagttcaagaccaacccgggaaacatagcaagactcccatctctacaaataaaaaacaaaaaaatgagccagccatggtggcacacgcctgtaatcccagcagcttgggaggatctgaggcgggaggatcatttgagcccaggagatcaaggctgcagtgagccatgatcgcaccactgcactgcagcctggggccacagagcaagaccctgcctcttt

SEQ ID NO: 194700 - DNA, 5774 bp, Homo sapiens
  Payload ID: 18473
  Gene Name: tripartite motif containing 11
  ENST ID: ENST00000493030
  CDS Start-End: 3711-4742
ctcgggggtgaggggcgtacctctcatagatagaggctaagagaggaaggtggaaggtggaaggtggtggagtgggggcaaggaaaatgtggccataccctggccagcaaggagctggaatcagaggaaagtgggagaacctcagaggtggccgatcctagatggactccctgcagggactgtgttagcaggtcagtacttaagtcctgggaaagccccagactgggcaggatgagggggacacagtcgtttcctctctaacctcccctccagggctgccctgcatttctgggtggggtactgggagccatctctgccatctgagatgccagggctcagcctgccttttctccccttgtcttgctgcttaaaacccaaataaaacccgagctgaagggcctggggcacacgttccctggcctgcgctccctcccgctgtcctctttcctcgctgacctgctgcaggtgtgctcctgggagcctacgtgtggggcagatggcagcatctttggagctttcttgattgcactttgtgtgttgcatcatggtcacttgtgtgtgccagatgagcagttaaggcagtgttagaatcagtactgagcttgatctgtccctatcacagagcaaacttctgggatactagaataaatctgaatctgtccccttctgctttggattttagcagaaaggtggtttagagccatatccgtgggcttgttcagacacagattcatttgggttttcttttctttgcccatgcaggaatgtctacacctgaaacatgttagcccagcagaattacccttgtgacaccaattaccccaatgggtgcagagagtgcccaatagctctatagagttgactcgatatagtttcatgggatagcacttaaccctttcttttgcaggtgaagaaaaaaatttccctctaccctgttaggttcagtggctcagggctgcaaattaaactggcacaagacaaattaacaggaaaaaaaatcatacaatttgattaatattttaagtttcacatgcacaagaacttcatagaaaagcgtatttcagcaaaggtttgtgaattgtggagaagtgactggacacagaaatgggattgggcgtctaggactgataaattgtgggaaagtgactaggaaatagatgggaagaattaacacaagataatggtcattgtagtaaggtctgtttaggcagaatcatctcccaggattagagtgccctcctcttcctggtagagagagggtgcctttctcatggggaatgaataccctacttttaggcagataggagtacagagagctcttcctgcatctgcttttactcagaataattcttgtaccacagcggtatatttggggatgacatcctgttcttcactgccttagagcctaggttatgttaaccacagcaaactgcttttacctgcccccatgggcctagaaagctcagtcccacctatggggctgtgtgtccacttgccagagctggggcccattagctccatgacaggttcactccttgcctggccctgacctggggtcatgacagctgaacaagccccaggctgggttgccccgaggtggtaaacagggaagtcccagtaagctccagttccaggaagcagcaccatgggagagagaagatggcccccagatctctctgggttgtgtgtcagatggcacttgtgtggggagggggtttgccacaggaaggaggaggccagggaagatcccaggcctgcaccaagccccagcatcccagttctgactacacgcagggtaagaggtttctgttctgatctggccagagacacaaagatgcaggtacctgaaatgcaagatctttgccatgctgggtatgttgtgctgctttacagcccattccatctgatcaaatgctgtttgtaaccttagtgttgaaaactgaaaacgttggccaggtgtggtggctcacgcctgtaatcccagcaatttgggaggccgaggtgggcggatcacctgaggtcaggagtttgagaccaccctggccaacatggtgaaatcccatctgtacaaaaaatacaaaaattagctgggtgtggtgatgggcacctgtaatcccagctactcagggggctgaggcagaagaatcacttgaacacaggaggcagaggttgcagtgagccgagatcgtgccactgcactccagcttgggggacaaagcgagactccgtctcaaaaaaagaaaactgaaaatgtcccgtagggactgaggcattgagggagaagtgagaggcactgggccaagtgtttgaggtggggttggggtcacaggggccaggcctgagttttctggaacaggtcggcagcagtgaggagagaggcctggggacagggaccgccatttggggttcttgtagctcacgtgagagctgagcctaggcagagacagtaaagcagttggacatgtccttggtgctccagcggtcttcccgaatcgtgaggccaagtggtgaactaaagtgagcacctggagccaggcagctgggctgaagtcctggctctgctaccggggcagacttctggaccctcccagcacctccatccttccagagcgtggatagcgagagatgagagccaagacttggggtggctgagaagcaaagaggtgtggccagcacagggcccgttgctgataagggtgtcagatggggtggaagtgagcagacccttcgagaagtgggttcagggcaccccaagcacacacagtacagtgagcttgtgtacaggattttcactgcttcctggtatgcacagcatgaggaaccgtgggaatgagaattaaggaccaagaaagcagaatggaggtgtacccatcctggagcttattacagtgatagctgatgaagctgaaaatgcacaaggtcccgagtggcttggagaaaagatagggtgggtagccaggcatgtctgtccgtgctgactgtcctaccaaaacaccatggtttgcacatggcagatgtatacaagctggagactcacagctctggaggctggaagtctaagatcaagccctggcaggtttggtgtctggtgagggtgcttcctggttcacagacaacaccctctcactgtgttgtcatatggtgaaaggggcgagggttcctttataacactaatcccattgtggcggcactgccctcctgacctagtcacctcccaaagcccccgcctcctaacatcatcacactgggtgttgggatttcaacctatgaatttgtgggggcatagggcagaatttttggaccccagcataggcttggtccaaggcccttatgtgagccagcaggtgagaaggaagaggaggaggagtagacactggcttgggaacaggagagctcagcaccttcagagccagcttggggacagatggggtgggcagccagaacccttgaggtagctttgcaaaggggggtgaggcctgggctagggtagcaaggtcgaggactagaaatgccccatatgagaaaaaggaaagaatgtggctggggctgtcagcctctggcaagaggctgcccacctaccatgagggctcacgcttattggagggcattgagttccctgattcaccaggcagatttcagtttgtccccattgtctttgaggaggggacagggtgtcaggtgcaaaagggcaggcttctgtgacaggactcatgtctcatggtcctgcctggcctctcccgcaggcgaagctggagaagtcactggagcatctccggaagcagatgcaggatgcgttgctgttccaagcccaggcggatgagacctgcgtcttgtggcagaagatggtggagagccagcggcagaacgtgctgggtgagttcgagcgtcttcgccgtttgctggcagaggaggagcagcagctgctgcagaggctggaggaggaggagctggaggtgctgccccggctgcgggagggcgcagcccacctaggccagcagagcgcccacctagctgagctcatcgccgagctcgagggccgctgccagctgcctgctctggggctgctgcaggacatcaaggacgccctgcgcagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatctttcccgagatccccttctcggggacgctgcggcccctcttctcacccctgtccagcagcccgaccccgatgactatctgccggccgaaaggtgggtccggggacaccctggctccccagtgactcgggccctcctggaggagtcctgttgcctctcctgcccctccaggccactgagtgttttggccacttggaggacctgggaggagggagtgtgtcctttgagcaagaggaggaactcctggtgcctttctgagcctgcgtgggagaaccccaattctagcactccaggaaactgtgggagagtgtggggcaggctccgtcctccctgggagacccctccagccaccgggtgccacttaatgccaacagcccttaccaaagctgggagccccattgccccggcagctctggcctgtggttccagaagctgagaaaactccactggggcttgcagaatccagggttcacctaagctgcacagttcctgcagctttgccagccccctgaaagtcttgtgtaccccacctctgaagatgctgggggaggcagctgggatgggagccagccccatgcctgtctgtgaccccacagtgggtgagagcccgtcacagtcctgggtgtggctgctctggaagaattaggaggcagccataataagagtcttcagagagatgatgggaggggccagtgaggacaggaacagagagtagatgtcctataataaaggggcttctgggaggtgcctgggcacagatgtctgttcagcaggtgtgtgggcctagaggagagagcagagcccagaaatgtcttttgcaggcccacgttctgacttgaagctttcgtgggcatgttgccattgggttttgcccttgcaaaggcttcctaggtctccagtggcccctcaggacccagggtcccagctgctgcttggggatgtgcactgctggccgccggccttgcagtctctctaccctggggaggaacagtggcttctcagagcctggggcatacagaagaaggcaggagttgatttttgtgttgggtttggggtttctttgtcctcaaggtactgttctgtttctctttacccctctgctttatttattgtaagcattcccacgttaaataaactttggctgttgtctacaagtc

SEQ ID NO: 194701 - DNA, 682 bp, Homo sapiens
  Payload ID: 18473
  Gene Name: tripartite motif containing 11
  ENST ID: ENST00000602582
  CDS Start-End: 1-682
gcggccgctgcaggacgcggccgaagacctcaaggcgaagctggagaagtcactggagcatctccggaagcagatgcaggatgcgttgctgttccaagcccaggcggatgagacctgcgtcttgtggcaggacatcaaggacgccctgcgcagggtccaggatgtgaagctgcagcccccagaagttgtgcctatggagctgaggaccgtgtgcagggtcccgggactggtagagacactgcggaggtttcgaggggacgtgaccttggacccggacaccgccaaccctgagctgatcctgtctgaagacaggcggagcgtgcagcggggggacctacggcaggccctgccggacagcccagagcgctttgaccccggcccctgcgtgctgggccaggagcgcttcacctcaggccgccactactgggaggtggaggttggggaccgcaccagctgggccctgggggtgtgcagggagaacgtgaacaggaaggagaagggcgagctgtccgcgggcaacggcttctggatcctggtcttcctggggagctattacaattcctcggaacgggccttggctccactccgggacccacccaggcgcgtggggatctttctggactacgaggctggacatctctctttctacagtgccaccgatgggtcactgctattcatcttt

SEQ ID NO: 194702 - DNA, 586 bp, Homo sapiens
  Payload ID: 18473
  Gene Name: tripartite motif containing 11
  ENST ID: ENST00000602308
  CDS Start-End: 1-165
cggccgctgcaggacgcggccgaagacctcaaggacatcaaggacgccctgcgcaggtacgaacccagcctctcctggagggggggcaggagggagtggggtgggacccagctgttggccatggcgacaacacctgggttgtcccctctagggtccaggatgtgaagctgcagcccccagaagttgtgcctatggagctgaggaccgtgtgcagggtcccgggactggtagagacactgcggaggtttcgaggtaggtgtggaggccccaggtggggagatgactccaggaggggacctgccaaggacctgggcagccagccacgtgttctgtgccctgccactgccagctccaaactcacagtgtcatggtggtgggttgttgggaaaacgtcctctgctcatacttctgacatcagttgtgtgggtattttcacaccaaacaattcttcaacttctggaaacgaattgggtatccaaggattccattcagcattgaacagaattgccagtgctgacactacaggagttagtacagaccccacagattaagggctcagtcccataagactgcccccacttcagat

SEQ ID NO: 194703 - DNA, 1637 bp, Homo sapiens
  Payload ID: 18474
  Gene Name: tripartite motif containing 13
  Uniprot ID: O60858
  ENST ID: ENST00000356017
  CDS Start-End: 389-1621
gccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtat

SEQ ID NO: 194704 - DNA, 7249 bp, Homo sapiens
  Payload ID: 18474
  Gene Name: tripartite motif containing 13
  Uniprot ID: O60858
  ENST ID: ENST00000378182
  CDS Start-End: 739-1962
ccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccaggtcagcagggatctgcgtgggttgggggggctggcgaaggccgtctgagctccagtccggcagcgcggcagaaaccagcggggcactgtcatgggcctggggaggagcggcctgcggagggcgccggggcagtgtgtctgtggtccagaaaacctgctccgtccggagccttcctggccccgctaccagcgtctccacatcccctagaaaagaaaagacgggtgtgggccttaggttacagcgcgccgccagcgtttggttgcatggcgccgggggagggcgccctaaccgagaagctgcttaatacaaagagctccaggctcctggcggttcaccaggtctaaacagccgggctttatttgtgggggcgattgaaaaaattgagggtcaagattggggtgctgtgcaaataaatgcgttaatactgttctttttcttctttctttgcagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatacgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaa

SEQ ID NO: 194705 - DNA, 1251 bp, Homo sapiens
  Payload ID: 18474
  Gene Name: tripartite motif containing 13
  ENST ID: ENST00000378183
  CDS Start-End: 452-1251
cttaattgcacggcagcttaactgggagactttcttcccgggcggccccacccgggaccgcgccgcttcagtcgagcccaccgtctgggcaaacggcgtccacttcccggagccgctgcccagcctctgcgggggggctttgggcgggcgcaggactctggaagggagaaaagcccgcagcccggccctccccgtcccaggcggcccgcgcgggtggacggcgggagcaggcggcggttggagacgccggaaggaacgcggtctcaccacccggctccctccgccaaggcgaggcgcggccggggaggcgggacacaggcgaagcgggacggggaggcggggccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactccttt

SEQ ID NO: 194706 - DNA, 1489 bp, Homo sapiens
  Payload ID: 18474
  Gene Name: tripartite motif containing 13
  Uniprot ID: O60858
  ENST ID: ENST00000457662
  CDS Start-End: 262-1485
gtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatc

SEQ ID NO: 194707 - DNA, 692 bp, Homo sapiens
  Payload ID: 18474
  Gene Name: tripartite motif containing 13
  ENST ID: ENST00000442421
  CDS Start-End: 306-692
acttctcccaagatcgtaaattctggaggagccattccttcatcatccatgtttgcatccttcacaccgttcactggttaagtgcttatagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgt

SEQ ID NO: 194708 - DNA, 2607 bp, Homo sapiens
  Payload ID: 18474
  Gene Name: tripartite motif containing 13
  Uniprot ID: O60858
  ENST ID: ENST00000420995
  CDS Start-End: 217-1440
ggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaa

SEQ ID NO: 194709 - DNA, 1479 bp, Homo sapiens
  Payload ID: 18475
  Gene Name: tripartite motif containing 14
  Uniprot ID: Q14142
  ENST ID: ENST00000342043
  CDS Start-End: 11-1339
gtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagacttgaatctgtagacatttctttattgatatggcaaattgcttgcagatatttttaaatgacagcaattttctaatatttggtttaataaaatgtgaataatgtccctttt

SEQ ID NO: 194710 - DNA, 4454 bp, Homo sapiens
  Payload ID: 18475
  Gene Name: tripartite motif containing 14
  Uniprot ID: Q14142
  ENST ID: ENST00000341469
  CDS Start-End: 11-1339
gtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccctactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttt

SEQ ID NO: 194711 - DNA, 1792 bp, Homo sapiens
  Payload ID: 18475
  Gene Name: tripartite motif containing 14
  Uniprot ID: Q14142
  ENST ID: ENST00000375098
  CDS Start-End: 23-1351
gagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagaatgtcatggaagcagaatcgtacagtatgttcccttctgcatatgctgctttctcactcagcatcatttccttgagatgcatccaggctgctgcacgcatcaatagttcattcctggctgggcgcggtggctcacgcctgtaatcccagcgctttgggaggccgatgtgggtggatcacaaggtcaggagtttgagactagcctggccaagatggtgaaaccccatctctgcaaaaaatacaaaaattagccgggcaccatggcatgtgcctgtaatccctgctactcaggaggctgaggaaggagaatcacttgaacccgggcagcggaggttgcagtgagccgagatcacaccactgcactccagcctgggcaatagagtgagactccgtttcaaaaaaaaaaagaaaaa

SEQ ID NO: 194712 - DNA, 639 bp, Homo sapiens
  Payload ID: 18475
  Gene Name: tripartite motif containing 14
  ENST ID: ENST00000475147
  CDS Start-End: 25-357
gggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgt

SEQ ID NO: 194713 - DNA, 2214 bp, Homo sapiens
  Payload ID: 18476
  Gene Name: tripartite motif containing 15
  Uniprot ID: Q9C019
  ENST ID: ENST00000259930
  CDS Start-End: 470-1867
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 194714 - DNA, 426 bp, Homo sapiens
  Payload ID: 18476
  Gene Name: tripartite motif containing 15
  Uniprot ID: Q9C019
  ENST ID: ENST00000376688
  CDS Start-End: 1-348
atgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtacctcagagtgcagaaccacagacggcttcggctgtgcctagggcaacagccaacctaggagccagcgggctttcggggaaaaaaaagaaaaagacatctaaaataaaatgtttaaactg

SEQ ID NO: 194715 - DNA, 2214 bp, Homo sapiens
  Payload ID: 18476
  Gene Name: tripartite motif containing 15
  Uniprot ID: Q9C019
  ENST ID: ENST00000376694
  CDS Start-End: 470-1867
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 194716 - DNA, 491 bp, Homo sapiens
  Payload ID: 18476
  Gene Name: tripartite motif containing 15
  ENST ID: ENST00000426765
  CDS Start-End: 1-491
gcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagagcctgccagacagccccctgcgcttcgacggcct

SEQ ID NO: 194717 - DNA, 491 bp, Homo sapiens; identical to SEQ ID NO: 194716
  Payload ID: 18476
  Gene Name: tripartite motif containing 15
  ENST ID: ENST00000425255
  CDS Start-End: 1-491

SEQ ID NO: 194718 - DNA, 491 bp, Homo sapiens; identical to SEQ ID NO: 194716
  Payload ID: 18476
  Gene Name: tripartite motif containing 15
  ENST ID: ENST00000427952
  CDS Start-End: 1-491

SEQ ID NO: 194719 - DNA, 2214 bp, Homo sapiens
  Payload ID: 18476
  Gene Name: tripartite motif containing 15
  ENST ID: ENST00000430090
  CDS Start-End: 470-1867
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagaacctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 194720 - DNA, 491 bp, Homo sapiens; identical to SEQ ID NO: 194716
  Payload ID: 18476
  Gene Name: tripartite motif containing 15
  ENST ID: ENST00000433744
  CDS Start-End: 1-491

SEQ ID NO: 194721 - DNA, 491 bp, Homo sapiens; identical to SEQ ID NO: 194716
  Payload ID: 18476
  Gene Name: tripartite motif containing 15
  ENST ID: ENST00000423220
  CDS Start-End: 1-491

SEQ ID NO: 194722 - DNA, 491 bp, Homo sapiens
  Payload ID: 18476
  Gene Name: tripartite motif containing 15
  ENST ID: ENST00000440260
  CDS Start-End: 1-491
gcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcagaccgccagccggagcctggttctctcggaagacaggaagtcagtgaggtacacccggcagaagaagaacctgccagacagccccctgcgcttcgacggcct

SEQ ID NO: 194723 - DNA, 2214 bp, Homo sapiens
  Payload ID: 18476
  Gene Name: tripartite motif containing 15
  Uniprot ID: Q9C019
  ENST ID: ENST00000431059
  CDS Start-End: 470-1867
tgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttcaaaataa

SEQ ID NO: 194724 - DNA, 491 bp, Homo sapiens; identical to SEQ ID NO: 194722
  Payload ID: 18476
  Gene Name: tripartite motif containing 15
  ENST ID: ENST00000424597
  CDS Start-End: 1-491

SEQ ID NO: 194725 - DNA, 2214 bp, Homo sapiens; identical to SEQ ID NO: 194719
  Payload ID: 18476
  Gene Name: tripartite motif containing 15
  ENST ID: ENST00000429524
  CDS Start-End: 470-1867

SEQ ID NO: 194726 - DNA, 2214 bp, Homo sapiens; identical to SEQ ID NO: 194723
  Payload ID: 18476
  Gene Name: tripartite motif containing 15
  Uniprot ID: Q9C019
  ENST ID: ENST00000427091
  CDS Start-End: 470-1867

SEQ ID NO: 194727 - DNA, 491 bp, Homo sapiens; identical to SEQ ID NO: 194716
  Payload ID: 18476
  Gene Name: tripartite motif containing 15
  ENST ID: ENST00000444157
  CDS Start-End: 1-491

SEQ ID NO: 194728 - DNA, 2214 bp, Homo sapiens; identical to SEQ ID NO: 194713
  Payload ID: 18476
  Gene Name: tripartite motif containing 15
  Uniprot ID: Q9C019
  ENST ID: ENST00000421984
  CDS Start-End: 470-1867

SEQ ID NO: 194729 - DNA, 2214 bp, Homo sapiens; identical to SEQ ID NO: 194723
  Payload ID: 18476
  Gene Name: tripartite motif containing 15
  Uniprot ID: Q9C019
  ENST ID: ENST00000414873
  CDS Start-End: 470-1867

SEQ ID NO: 194730 - DNA, 2217 bp, Homo sapiens
  Payload ID: 18476
  Gene Name: tripartite motif containing 15
  ENST ID: ENST00000546888
  CDS Start-End: 687-1877
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagaacctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 194731 - DNA, 2217 bp, Homo sapiens
  Payload ID: 18476
  Gene Name: tripartite motif containing 15
  ENST ID: ENST00000548653
  CDS Start-End: 687-1877
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 194732 - DNA, 426 bp, Homo sapiens
  Payload ID: 18476
  Gene Name: tripartite motif containing 15
  Uniprot ID: Q9C019
  ENST ID: ENST00000550400
  CDS Start-End: 1-348
atgcccgcaaccccgtccctgaaggtggtccatgagctgcctgcctgtaccctatgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtacctcagagtgcagaaccacagacggcttcggctgtgcctagggcaacagccaacctaggagccagcgggctttcggggaaaaaaaagaaaaagacatctaaaataaaatgtttaaactg

SEQ ID NO: 194733 - DNA, 2217 bp, Homo sapiens
  Payload ID: 18476
  Gene Name: tripartite motif containing 15
  ENST ID: ENST00000550969
  CDS Start-End: 687-1877
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctctcagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgcacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 194734 - DNA, 2217 bp, Homo sapiens; identical to SEQ ID NO: 194731
  Payload ID: 18476
  Gene Name: tripartite motif containing 15
  ENST ID: ENST00000552062
  CDS Start-End: 687-1877

SEQ ID NO: 194735 - DNA, 2217 bp, Homo sapiens; identical to SEQ ID NO: 194730
  Payload ID: 18476
  Gene Name: tripartite motif containing 15
  ENST ID: ENST00000550702
  CDS Start-End: 687-1877

SEQ ID NO: 194736 - DNA, 2217 bp, Homo sapiens; identical to SEQ ID NO: 194733
  Payload ID: 18476
  Gene Name: tripartite motif containing 15
  ENST ID: ENST00000548732
  CDS Start-End: 687-1877

SEQ ID NO: 194737 - DNA, 426 bp, Homo sapiens; identical to SEQ ID NO: 194714
  Payload ID: 18476
  Gene Name: tripartite motif containing 15
  Uniprot ID: Q9C019
  ENST ID: ENST00000552836
  CDS Start-End: 1-348

SEQ ID NO: 194738 - DNA, 426 bp, Homo sapiens; identical to SEQ ID NO: 194714
  Payload ID: 18476
  Gene Name: tripartite motif containing 15
  Uniprot ID: Q9C019
  ENST ID: ENST00000552676
  CDS Start-End: 1-348

SEQ ID NO: 194739 - DNA, 2217 bp, Homo sapiens; identical to SEQ ID NO: 194731
  Payload ID: 18476
  Gene Name: tripartite motif containing 15
  ENST ID: ENST00000550694
  CDS Start-End: 687-1877

SEQ ID NO: 194740 - DNA, 2217 bp, Homo sapiens
  Payload ID: 18476
  Gene Name: tripartite motif containing 15
  ENST ID: ENST00000619857
  CDS Start-End: 687-1877
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagaggaacaattgtcacgtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttc

SEQ ID NO: 194741 - DNA, 2900 bp, Homo sapiens
  Payload ID: 18477
  Gene Name: tripartite motif containing 16
  Uniprot ID: O95361
  ENST ID: ENST00000336708
  CDS Start-End: 558-2252
gatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgt

SEQ ID NO: 194742 - DNA, 3184 bp, Homo sapiens
  Payload ID: 18477
  Gene Name: tripartite motif containing 16
  ENST ID: ENST00000416464
  CDS Start-End: 1225-2529
tttctctggaggatctccgcgcgtggcgagtctgtgtcctccctgtcccccagagcagacaccctctctgtgtctggaccggggaggagcagacgctggacagggtgtgtgtgttcagcagtggattgtcagacttggggtcccggctgctcccttttgggtctctccccgggcccgctgatctgactgtaattccttctgctggagctagggttcggccaccttgacgcgccccctctgcccctggagcgtgtctttgggttttgtgtgtgtgggagtggggtgtatgtgtgtttcttatccgagacacctctgggtcgtttgcttggaaaccggctgagggcccgcataccctggagcatttggttgcaaagtgaggcaggtagcgcccaaggctcctgtaccagggccaggttaggcaccaacgcgtcccttatgtctctgcagcctgcagtgtggtggaaccgtttcatagactgaagtgtgaacgtaggaggggatggatatcagagatctgtttatccacattttcagagagtggtattgctctgatgtgagcgtaggcaggttactctctgtgtctcgtgttctttacctgtaatttgaggtttgttgtacctactattaagtggtggttgtgaggattaaatggaattttgacatgcaacagttgacacagggccagacaccaagtaagggatcaatcagttgttgcttttattaatagtaggcatccatctgcccatttgcacgtaagaaggaaacacccaagaatgaaaagtagcttgttgtaggtcacccagccaactagcacatagtggaaattagaatccaggcactcccagcagggcactttccaccaccctgcacttttgtattcatcaggcacagtatccttactgttgtctgtaactgtctatgttcccagtgtctgactctgcagggccctagtggtataaaggtactgagacttgcctgtgttcagggcttcctgaagattaaatggctgccgaagttcttgagtttagctttagctcaaaagatactgcgtcagactctgcgttctgagtagagtctcagagaatgaaaaaagaaatacaatgaaaaaggggaaaacttcaatccagaacctcttaccacagtttctggtagaatgctggcaatttccaggaagatacgtggagaacggaaaggttgctacacccaaatagtgaagcaaaggctatgattatggaggattggacctgcaaactccagaacagagttctgccctctgaggaccctgccctttcccaaaaggggtatcttaagaaggaaaatatggctgctctttgccggacagcagagtcccaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcct

SEQ ID NO: 194743 - DNA, 1979 bp, Homo sapiens
  Payload ID: 18477
  Gene Name: tripartite motif containing 16
  Uniprot ID: O95361
  ENST ID: ENST00000577886
  CDS Start-End: 278-1324
gtgcctcccggctggtttctgagatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcct

SEQ ID NO: 194744 - DNA, 3206 bp, Homo sapiens
  Payload ID: 18477
  Gene Name: tripartite motif containing 16
  Uniprot ID: O95361
  ENST ID: ENST00000578237
  CDS Start-End: 857-2551
ctttctctggaggatctccgcgcgtggcgagtctgtgtcctccctgtcccccagagcagacaccctctctgtgtctggaccggggaggagcagacgctggacaggtttctggtagaatgctggcaatttccaggaagatacgtggagaacggaaaggttgctacacccaaatagtgaagcaaaggctatgattatggaggattggacctgcaaactccagaacagagcaaccttgtaaaatgtgtgtgggcagcacagagaacttgggcaagttaacagtttcctcatctgtgaatactgatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcct

SEQ ID NO: 194745 - DNA, 560 bp, Homo sapiens
  Payload ID: 18477
  Gene Name: tripartite motif containing 16
  ENST ID: ENST00000577372
  CDS Start-End: 216-560
gctgtatcagtaattccaaaagggaggaagttataatgagccatgtctgacctcccttcccatcatggcctgaactggtttttcaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaag

SEQ ID NO: 194746 - DNA, 486 bp, Homo sapiens
  Payload ID: 18477
  Gene Name: tripartite motif containing 16
  ENST ID: ENST00000581200
  CDS Start-End: 198-486
tttccggcccctttctctggaggatctccgcgcgtggcgagtctgtgtcctccctgtcccccagagcagacaccctctctgtgtctggaccggggaggagcagacgctggacaggtttctggtagaatgctggcaatttccaggaagatacgtggagaacggaaaggttgctacacccaaatagtgaagcaaaggctatgattatggaggattggacctgcaaactccagaacagagttctgccctctgaggaccctgccctttcccaaaaggggtatcttaagaaggaaaatatggctgctctttgccggacagcagagtcccaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtga

SEQ ID NO: 194747 - DNA, 999 bp, Homo sapiens
  Payload ID: 18477
  Gene Name: tripartite motif containing 16
  ENST ID: ENST00000579219
  CDS Start-End: 248-670
acagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggagatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaag

SEQ ID NO: 194748 - DNA, 580 bp, Homo sapiens
  Payload ID: 18477
  Gene Name: tripartite motif containing 16
  ENST ID: ENST00000580110
  CDS Start-End: 246-580
agaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggagaggagtatgacatcagaactcaagtgtctgccgttgttcagcgcaaatattggacttccaaacctgagcccagcaccagggaacagttcctccaatatgcgtatgacatcacgtttgacccggacacagcacac

SEQ ID NO: 194749 - DNA, 426 bp, Homo sapiens
  Payload ID: 18477
  Gene Name: tripartite motif containing 16
  ENST ID: ENST00000494759
  CDS Start-End: 1-168
gggtatcttaagaaggaaaatatggctgctctttgccggacagcagagtcccagaaccccatgcaggtgtttcagggctttatgtcattcaaggatgtggctgtgaacttcactaggaagaatggagagaactggaccttgctcagagagtcttgtacagggatgtaatgctggagaactataggaacctggtctccttggtaggatttccattttccaaacctggtatcatctcctagttggaagaagtggtaagcccacgaacacaaatgcaggagggagaggtgccaagaagcagcggtacacgagaaagacagggctggagaccagtttgctgatagtgaccccaaaccagaaagttcattgggcctgcacctccagtagaactggacctgaggcagctaggaataggatgcatgtttctga

SEQ ID NO: 194750 - DNA, 552 bp, Homo sapiens
  Payload ID: 18477
  Gene Name: tripartite motif containing 16
  ENST ID: ENST00000578744
  CDS Start-End: 1-552
ctttcccaaaaggggtatcttaagaaggaaaatatggctgctctttgccggacagcagagtcccaggagaaagacagggctggagaccagtttgctgatagtgaccccaaaccagaaagttcattgggcctgcacctccaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatc

SEQ ID NO: 194751 - DNA, 791 bp, Homo sapiens
  Payload ID: 18477
  Gene Name: tripartite motif containing 16
  ENST ID: ENST00000577446
  CDS Start-End: 1-699
gccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtaaatgtcacactgtgcccagaatggatgaccaggaaccttaaagagtggctgaaaagattgcagagttatcataataaattgctaacttgcgta

SEQ ID NO: 194752 - DNA, 2048 bp, Homo sapiens
  Payload ID: 18478
  Gene Name: tripartite motif containing 16-like
  Uniprot ID: Q309B1
  ENST ID: ENST00000395671
  CDS Start-End: 344-1390
actgtattttcgctgactcatgctgactgcagccccaggagggcacgggctcaccgccaacccttcgtgcctcccggctggtttctgagatcagccacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttgcagtaattctttttttttttttttttgagacggagtctcgcactgttgcccaggctggagtgcagtggcgtgatcttggctcactgcaagctccgcctcccgagttcaagcaattctcctgcctcagcctcccgagtagctgggattacaggtgcctgccaccacacccagctaacgttttgtatttttagtagagatggggtttcaccatgttggccaggcagatctcaaacttctgacctcgtgatgcactcacctcggcctcccaaagtgctgggattacaggcgtgagccactgcgccctgcctgtttgtagtaatttttaggcaccaaatctccctcatcttctagtgccattctcctctctgttcaggtaaatgtcacactgtgcccagaatggatgaccaggaaccttcaagagtggctgaaaagattgcagagttatcataataaattgctaacttgcgtatttcct

SEQ ID NO: 194753 - DNA, 588 bp, Homo sapiens
  Payload ID: 18478
  Gene Name: tripartite motif containing 16-like
  ENST ID: ENST00000424146
  CDS Start-End: 246-588
agaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggagaggagtatgacatcagaactcaagtgtctgccattgttcagcgcaaatattggacttccaaacctgagcccagcaccagggaacagttcctccaatatgtgcatgacatcacgttcgacccggacacagcacacaagtatct

SEQ ID NO: 194754 - DNA, 999 bp, Homo sapiens
  Payload ID: 18478
  Gene Name: tripartite motif containing 16-like
  Uniprot ID: Q309B1
  ENST ID: ENST00000414850
  CDS Start-End: 248-670
acagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggagatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaag

SEQ ID NO: 194755 - DNA, 560 bp, Homo sapiens
  Payload ID: 18478
  Gene Name: tripartite motif containing 16-like
  ENST ID: ENST00000573443
  CDS Start-End: 216-560
gctgtatcagtaattccaaaagggaggaagttataatgagccatgtctgacctcccttcccatcatggcctgaactggtttttcaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaag

SEQ ID NO: 194756 - DNA, 791 bp, Homo sapiens
  Payload ID: 18478
  Gene Name: tripartite motif containing 16-like
  ENST ID: ENST00000574042
  CDS Start-End: 1-699
gccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtaaatgtcacactgtgcccagaatggatgaccaggaaccttcaagagtggctgaaaagattgcagagttatcataataaattgctaacttgcgta

SEQ ID NO: 194757 - DNA, 1809 bp, Homo sapiens
  Payload ID: 18478
  Gene Name: tripartite motif containing 16-like
  Uniprot ID: Q309B1
  ENST ID: ENST00000572555
  CDS Start-End: 556-1602
gcttctggcccctttctctggaggagctccgcgcgtggcgagtctgtgtcctccctgtcccccagagcagagaaccctctctgtgtctggacgggggaggagcagacgctggacaggtttttggcaaaatgctggcaattcccaggaagatatgtggagaacggaaaggttgctacacccaaatagtggcgcaaaggctatgattatggaggattggacctgcaaactccagaacagagcaaccttgtaaaatgtgtgtgggcagcacagagaccttgggcaagttaacagtttcctcatctgtaaatactgatttatggaaagcacctggtgtatgttctgccctctgaggaccctgccctttcccaaaaggggtatcttaagaaggaaaatatggctgctctttgccggacagcagagtcccaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttgcagtaattcttttttttttttttt

SEQ ID NO: 194758 - DNA, 984 bp, Homo sapiens
  Payload ID: 18478
  Gene Name: tripartite motif containing 16-like
  ENST ID: ENST00000571542
  CDS Start-End: 311-984
cacagaagttaaacttctttccagggaagaagggcggggatgtcagggctggagagtgcccgtgtccttctgtgtgcattgggctccttcctccttaattctctgctttccacttttaggctgaactccagtgcacccagttagacttggagcggaaactcaagttgaatgaaaatgccatctccaggctccaggctaaccaaaagtctgttctggctccttgaatgtattgaggcctctcctctctgtactatttctgcttgtcatcattttcgtggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcaccta

SEQ ID NO: 194759 - DNA, 3189 bp, Homo sapiens
  Payload ID: 18478
  Gene Name: tripartite motif containing 16-like
  Uniprot ID: Q309B1
  ENST ID: ENST00000449552
  CDS Start-End: 1485-2531
tttctctggaggagctccgcgcgtggcgagtctgtgtcctccctgtcccccagagcagagaaccctctctgtgtctggacgggggaggagcagacgctggacagggtgtgtgtgttcagcagtggattgtcagacttggggtcccggctgctcccttttgggtctctccccgggcccgctgatctgactgtaattccttctgctggagctagggttcggccaccttgacgcgccccctctgcccccggagcgtgtctttgggttttgtgtgtgtgggagtggggtgtatgtgtgtttcttatccgagacacctccgggtcgtttgcttggaaaccggctgagggcccgcacagcctggagcatttggttggaaagtgaggcaggtagcgcccaaggctcctgtaccagggccaggttaggcaccaacgcgtcccttatgtctctgcagcctgcagtgcggtggaaccgttttatagactgacagtgtgaacgtgggaggggatggatatcagagacccgtttatccacattttcagagagtggtattgctccgatgtgagtgtaggcaggttactctctgtgtctcgtgttctttacctgtaatttgaggtttgttgtacctacttttaagtggtggttgtgaggattaaatggaattttgacatgcaacagttgacacagggccagacaccaagtaagggatcaatcagttgttgcttttattaatagtaggcatccatctgcccacttgtacgtaagaaggaaacacccaagaatgaaaagtagcttgttgtaggtcacccagccaactagcacataggggaaattagaatccaggcactcccagcagggcactttccaccaccctgcacttttgtattcatcaggcacaatatccttactgttgtctgtaactgtctatgttcccagtgtctgactctgcagggccctggtggtataaaggtactgagacttgcctgtgtttagggcttcctgaagattaaatggctgctgaagttcttgagtttagctttagctcaaaagatactgcgtcagactctgcgttctgagtagagtctcagacaatgaaaaaagaaatacaatgaaaaaggggaaaacttcaatccagaatctcttgccacagtttttggcaaaatgctggcaattcccaggaagatatgtggagaacggaaaggttgctacacccaaatagtggcgcaaaggctatgattatggaggattggacctgcaaactccagaacagagttctgccctctgaggaccctgccctttcccaaaaggggtatcttaagaaggaaaatatggctgctctttgccggacagcagagtcccaggctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcaaaaataactgctgatggtagctggcttttgaaatcctatggggtctctgaatgaaaacattctccagctgctctcttttgctccatatggtgctgttctctatgtgtttgcagtaattctttttttttttttttttgagacggagtctcgcactgttgcccaggctggagtgcagtggcgtgatcttggctcactgcaagctccgcctcccgagttcaagcaattctcctgcctcagcctcccgagtagctgggattacaggtgcctgccaccacacccagctaacgttttgtatttttagtagagatggggtttcaccatgttggccaggcagatctcaaacttctgacctcgtgatgcactcacctcggcctcccaaagtgctgggattacaggcgtgagccactgcgccctgcctgtttgtagtaatttttaggcaccaaatctccctcatcttctagtgccattctcctctctgttcaggtaaatgtcacactgtgcccagaatggatgaccaggaaccttcaagagtggctgaaaagattgcagagttatcataataaattgctaacttgcgtatttcct

SEQ ID NO: 194760 - DNA, 526 bp, Homo sapiens
  Payload ID: 18478
  Gene Name: tripartite motif containing 16-like
  ENST ID: ENST00000577969
  CDS Start-End: 120-281
agtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaat

SEQ ID NO: 194761 - DNA, 1703 bp, Homo sapiens
  Payload ID: 18478
  Gene Name: tripartite motif containing 16-like
  Uniprot ID: Q309B1
  ENST ID: ENST00000571708
  CDS Start-End: 627-1673
ccaaatagtggcgcaaaggctatgattatggaggattggacctgcaaactccagaacagagcaaccttgtaaaatgtgtgtgggcagcacagagaccttgggcaagttaacagtttcctcatctgtaaatactgatttatggaaagcacctggtgtatgttctgccctctgaggaccctgccctttcccaaaaggggtatcttaagaaggaaaatatggctgctctttgccggacagcagagtcccagaaccccatgcaggtgtttcagggctttacgtcattcaaggatgtggctgtgaacttcactaggaagaatggagagtactggaccttgctcagagagtcttgtacagggatgtaatgctggagaactataggaacctggtctccttgggatttccattttccaaacctggtatcatctcctagttggaagaagtggtaggcccacgaacgcaaatgcaggagggagaggtgccaagaagcagctgtacacgctgaactccagtgcacccagttagacttggagcggaaactcaagttgaatgaaaatgccatctccaggctccaggctaaccaaaagtctgttctggtgtcggtgtcagaggtcaaagcagtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagtaagcaggagctggagacgatggcggccatcagcaacactgtccagttcttggaggagtactgcaagtttaagaacactgaagacatcaccttccctagtgtttacatagggctgaaggataaactctcgggcatccgcaaagttatcacggaatccactgtacacttaatccagttgctggagaactataagaaaaagctccaggagttttccaaggaagaggagtatgacatcagaactcaagtgtctgccattgttcagcgcaaatattggacttccaaacctgagcccagcaccagggaacagttcctccaatatgtgcatgacatcacgttcgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccagaaaggggaggagcgcagcagttgcatttccggaaacaacttctcctggagcctccaatggaacgggaaggagttcacggcctggtacagtgacatggagaccccactcaaagctggccctttctggaggctcggggtctatattgacttcccaggagggatcctttccttctatggcgtagagtatgattccatgactctggttcacaagtttgcctgcaagttttcagaaccagtctatgctgccttctggctttccaagaaggaaaacgccatccggattgtagatctgggagaggaacccgagaagccagcaccgtccttggtggggactgctccctagactccaggagccatatcccagacctttgcc

SEQ ID NO: 194762 - DNA, 1730 bp, Homo sapiens
  Payload ID: 18479
  Gene Name: tripartite motif containing 17
  Uniprot ID: Q9Y577
  ENST ID: ENST00000295033
  CDS Start-End: 132-1565
ccccaggtccccacgccccgggccgggccgcagcctcctgggcttcgtgggggcagacccagcctttcccggcagcgagcgctcggccaggtgcactaggcgctgtgcgggccccccttccccgcggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaa

SEQ ID NO: 194763 - DNA, 808 bp, Homo sapiens
  Payload ID: 18479
  Gene Name: tripartite motif containing 17
  ENST ID: ENST00000355586
  CDS Start-End: 283-808
ctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagg

SEQ ID NO: 194764 - DNA, 2652 bp, Homo sapiens
  Payload ID: 18479
  Gene Name: tripartite motif containing 17
  Uniprot ID: Q9Y577
  ENST ID: ENST00000366697
  CDS Start-End: 958-2391
agatctccactgcgtggggtcgcgagtgttgagattgcagggggcatctatgtgcatgcttgtgtgcctgtgcgtgtgtgcgcgcgtgtacctgtgtgtacatgcatgtatgtttaccgatatgtgcatctgtgcctgtgtgtgctgtgtttgtggatcagtgtttctgtgcgtacatgtttgtatttgtgtggtgtgtatgcgtgggtatgcgtgtgtgcacatgcacgtttgtatacatacatgggtatgtgtatgggtgttcgtctgtgcgtacatgcacacgcgtgttttttctgaaccccacctcactaccgaatggaagagagcttttttcctctgatagcccatcccttcttcctttggtgtacggggttttgttaaagaaaaaattctgacatttgaaaggctctttagtcaggctacttgcaatgggagagttgcgccagcaaagacagctggggatgtatgggggagttggagtggggatctgggtggggtcagtggatggaaagtgattaagggaaggctccaagggtaggggcttctccctaagctgacctagcaggcttctccagaaaggcaggttgaaggcctagccggcaacggtctgtcggggaggaggagctgatgagatgtggagctgggggtagccagcagcaggcggaagtggacgggtagggtccaggcccagtggagaggagaggcggaggggcctgcagagcattggtcagggagggtctgtgtagtttctggggaggcatctgtgtctgttgttgacaaggctaaaaatgatgactctggactctctaactggactgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacacc

SEQ ID NO: 194765 - DNA, 1748 bp, Homo sapiens
  Payload ID: 18479
  Gene Name: tripartite motif containing 17
  Uniprot ID: Q9Y577
  ENST ID: ENST00000366698
  CDS Start-End: 150-1583
cgggccgggccgcagcctcctgggcttcgtgggggcagacccagcctttcccggcagcgagcgctcggccaggtgcactaggcgctgtgcgggccccccttccccgcgagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaa

SEQ ID NO: 194766 - DNA, 575 bp, Homo sapiens
  Payload ID: 18479
  Gene Name: tripartite motif containing 17
  ENST ID: ENST00000457345
  CDS Start-End: 484-575
agtcagcacccgctgcgcctgtccccggctcgtccagagccttccaccccctgccgccttccttccccaagccacccccaacctctcctaagaggcgccgccccagtcccggccgccgaacactccctcgcccagcattcccctcccccgccgccccccagcccccgctgacgccacaaagtccctaggcctcccgaccccaggtccccacgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaagaccctgtgatgaccacctgtggccacaacttctgccgagcctgcatccagctgagctgggaaaaggcgaggggcaagaaggggaggcggaagcggaaggg

SEQ ID NO: 194767 - DNA, 1731 bp, Homo sapiens
  Payload ID: 18479
  Gene Name: tripartite motif containing 17
  Uniprot ID: Q9Y577
  ENST ID: ENST00000456946
  CDS Start-End: 377-1408
agtcccggccgccgaacactccctcgcccagcattcccctcccccgccgccccccagcccccgctgacgccacaaagtccctaggcctcccgaccccaggtccccacgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctaggtaagtgggcacccagggccaggacctctgacccaggatctcttggcgatgccccactgtaccccctagcctcggaagccaccaatggggggggttctacaagtgcactgcctggtgacggtcactggctattcactgtgccttcgtagggcggcgttactggtggttctaattcatgggatgaatcttgttgagttcccagtggtctctctgcccagccccctgtaccttattgccaccaaggcccacacacaattggtgtgtggaagcatcaagtaaccccagattcacagcaggggaggcctctgcggagttaggggaccattggccacatccaccactagggcccggggactcccacctttgaccctgaatgccccacacctctccccatctctccaccaccacgcccatctacagaggatgtggtgcctgatgccacctccgcgtacccctacctcctcctgtatga

SEQ ID NO: 194768 - DNA, 551 bp, Homo sapiens
  Payload ID: 18479
  Gene Name: tripartite motif containing 17
  ENST ID: ENST00000520264
  CDS Start-End: 400-551
acgccccgggccgggccgcagcctcctgggcttcgtgggggcagacccagcctttcccggcagcgagcgctcggccaggtgcactaggcgctgtgcgggccccccttccccgcggtgagtagcccccaccccgccgcctaggctaccctcctgtggcgcctgggccacgacctaagcctaacccggtcctcctcgccctccaacgcccggccttcccgcctccgccggccgccgcgtccctggaggggctagcgcgcttcaacaagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaa

SEQ ID NO: 194769 - DNA, 925 bp, Homo sapiens
  Payload ID: 18479
  Gene Name: tripartite motif containing 17
  ENST ID: ENST00000479800
  CDS Start-End: 124-925
cacgccccgggccgggccgcagcctcctgggcttcgtgggggcagacccagcctttcccggcagcgagcgctcggccaggtgcactaggcgctgtgcgggccccccttccccgcgaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctag

SEQ ID NO: 194770 - DNA, 6735 bp, Homo sapiens
  Payload ID: 18480
  Gene Name: tripartite motif containing 2
  Uniprot ID: Q9C040
  ENST ID: ENST00000338700
  CDS Start-End: 66-2381
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccattt

SEQ ID NO: 194771 - DNA, 654 bp, Homo sapiens
  Payload ID: 18480
  Gene Name: tripartite motif containing 2
  ENST ID: ENST00000433687
  CDS Start-End: 323-654
gtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaa

SEQ ID NO: 194772 - DNA, 583 bp, Homo sapiens
  Payload ID: 18480
  Gene Name: tripartite motif containing 2
  ENST ID: ENST00000441616
  CDS Start-End: 169-583
ttgcaaaacagaaccactgattccttcctgcttgacaagattgagtcgctatcaaggagctgcccgtgctttggaaatggtccaaatcgacgaggaactgccaaggagccccctcagacacagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtc
